United States Patent 12,234,506 (METHODS AND COMPOSITIONS FOR VIRAL NANO-FISH) - sequence listing, part 2

SEQ ID NO: 1426 - DNA, 32767 bp, Human mastadenovirus B
catcatcaataatataccttatagatggaatggtgccaatatgtaaatgaggtgattttaaaaattgcggggtgtgtggtgattggctgtgtggttaacggctaaaaggggcggcgcggccgtgggaaaatgacgttttttgggggtggagtttttttgcaagttgtcgcgggaaatgtgacgtatacaaaggcttttttctcacggaactacttagttttccccacggtatttaacaggaaatgaggtagttttggccggatgcaagtgaaaactgttcattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaaaatgagagatttgcgatttctgcctcaggaaataatctctgctgagactggaaatgaaatattggagcttgtggtgcacgccctaatgggagacgatccggagccacctgtgcagctttttgagcctcctacgcttcaggaactgtatgatttagaggtagagggatcggaggattctaatgaggaagctgtgaatggcttttttaccgattctgtgcttttagctgctaatgaaggattagaattagatccgcctttggacacttttgatactccaggggtgattgtggaaagcggtacaggtgtaagaaaattacctgatttgggttccgtggactgtgatttgcactgctatgaagacgggtttcctccgagtgatgaggaggaccatgaaaaggagcagtctatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgggagttttgtgtttcttattataggtcctgtgtctgatgctgatgaatcaccatctcctgattctactacctcacctcctgagattcaagcacctgttcctgtggacgtgcgcaagcccattcctgtgaagcctaagcctgggaaacgtccagcagtggagaaacttgaggacttgttacagggtggggacggacctttggacttgagtacacggaaacgtccaagacaataagtgttccatatccgtgtttacttaaggtgacgtcaatatttgtgtgagagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttggagaacgcttcggacggagtctccggtttttggagattctggttcgctagtgaattagctagggtagtttttaggataaaacaggactataaagaagaatttgaaaagttgttggtagattgcccaggactttttgaagctcttaatttgggccatcaggttcactttaaagaaaaagttttatcagttttagatttttcaaccccaggtagaactgccgctgctgtggcttttcttacttttatattagacaaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccacctgtcatgccagcggttctggaggaggaacagcaagaggacaatccgagagccggcctggaccctccagtggaggaggcggagtagctgacttgtctcctgaactgcaacgggtgcttactggatctacgtccactggacgggataggggcgttaagagggagagggcatccagtggtactgatgctagatctgagttggctttaagtttaatgtctcgcagacgtcctgaaaccatttggtggcatgaggttcagaaagagggaagggatgaagtttctgtattgcaggagaaatattcactggaacaggtgaaaacatgttggttggagccagaggatgattgggaggtggccattaaaaattatgcgaagatagctttgaggcctgataagcagtataagattactagacggattaatatccggaatgcttgttacatatctggaaatggggctgaggtggtaatagatactcaagacaagacagttattagatgctgcatgatggatatgtggcctggagtagtcggtatggaagcagtcacttttgtaaatgttaagtttaggggagatggttataatggaatagtgtttatggccaataccaaacttatattgcatggttgtagcttttttggtttcaacaatacctgtgtagatgcctggggacaggttagtgtgcgggggtgtagtttctatgcgtgttggattgccacagcaggcagaaccaagagtcaattgtctctgaagaaatgcatattccaaagatgtaacctgggcattctgaatgaaggcgaagcaagggtccgccactgcgcttctacagatactggatgttttattttaattaagggaaatgccagcgtaaagcataacatgatttgcggtgcttccgatgagaggccttatcaaatgctcacttgtgctggtgggcattgtaatatgctggctactgtgcatattgtttcccaccaacgcaaaaaatggcctgtttttgatcacaatgtgttgaccaagtgcaccatgcatgcaggtgggcgtagaggaatgtttatgccttaccagtgtaacatgaatcatgtgaaagtgttgttggaaccagatgccttttccagaatgagcctaacaggaatctttgacatgaacacgcaaatctggaagatcctgaggtatgatgatacgagatcaagggtgcgcgcatgcgaatgcggaggcaagcatgccaggttccagccggtgtgtgtagatgtgacggaagatctcagaccggatcatttggttattgcccgcactggagcagagttcggatccagtggagaagaaactgactaaggtgagtattggggaaactttggggtgggattttcagatagacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgccgccgcctctgtcgccgctaacactgtgcttggaatgggttactatggaagcatcgtggctaattccacttcctctaataacccttctaccctgactcaggacaagttacttgtccttttggcccagctggaggctttgacccaacgtctgggtgaactttctcagcaggtggccgagttgcgagtacaaactgagtctgctgtcggcacggcaaagtctaaataaaaaaattccagaatcaatgaataaataaacgagcttgttgttgatttaaatcaagtgtttttatttcatttttcgcgcacggtatgccctagaccaccgatctcgatcattgagaactcggtggattttttccagaatcctatagaggtgggattgaatgtttagatacatgggcattaggccatctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcgatattgccgccaagatcccgtcttgggttcatgttatgaaggaccaccaagacggtgtatccggtacatttaggaaatttgtcatgtagcttggatggaaaagcgtggaaaaatttggagacacccttgtgtcctccgagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagtttccctcacagatttgcatttcccaagctttcagttccgagggtggaatcatgtccacctggggggctatgaaaaacaccgtttctggggcgggggtgattagttgggatgatagcaaatttctgagcaattgagatttgccacatccggtggggccatatatgattccgattacaggttgcagatggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtttgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcattctgctggtcgagaacttctgtcgcttggcgccctgtatgtcggccaagtagcagtttaccatgagttcgtagttgagcgcctcggctgcgtggcctttggcgcgtagcttacctttggaagttttcttgcataccgggcagtataggcatttcagcgcatacagcttgggcgcgaggaaaatggattctggggagtatgcatccgcgccgcaggaggcgcaaacagtttcacattccaccagccaggttaaatccggttcattggggtcaaaaacaagttttccgccatattttttgatgcgtttcttacctttgctctccataagttcgtgtcctcgttgagtgacaaacaggctgtccgtatccccgtagactgattttacaggcctcttctccagtggtgtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgccaggcacttccattcggggaagatagttgtcaattcatctggcacgattctcacttgccaccctcgattatgcagggtaattaaatccacactggtggccacctcgcctcgaaggggttcgttggtccaacagagcctacctcctttcctagaacagaaagggggaagtgggtctagcataagttcatcgggagggtctgcatccatggtaaagattccaggaagtaaatccttatcaaaatagctgatgggagtggggtcatctaaggccatttgccattctcgagctgccagtgcgcgctcatatgggttaagaggactgccccagggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgccagcagccccggacccaagttggtacgattgggtttttctgttctgtagacaatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtccagggcgcagtagtcaagtgtttcttgaatgatgtcataacctggttggtttttcttttcccacagttcgcggttgagaaggtattcttcgcgatccttccagtattcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaaaaattggtatttgaagtccatgtcgtcacaggctccctgttcccagagttggaagtctacccgtttcttgtaggcggggttgggcaaagcgaaagtaacatcgttgaagagaatcttgccggctctgggcataaaattgcgagtgatgcggaaaggctgtggtacttccgctcgattgttgatcacctgggcagctaggacgatctcgtcgaaaccgttgatgttgtgtcctacgatgtataattctatgaaacgcggcgtgcctctgacgtgaggtagcttattgagctcatcaaaggttaggtctgtagggtcagataaggcgtagtgttcgagagcccattcgtgcaggtgaggatttgcatggaggaatgttgaccaaagatccaccgccagtgctgtttgtaactggtcccgatactgacgaaaatgttggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccaaacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgggggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaagtacatgatccatcgtctaagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcctcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagagagagggcgctgattatacattttattaattggcccgtagggactgcgcgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctattccttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaacccgcgcattggttgaaccagtgccaagtcagctacgactctttcggcgaggatggcttgctgtacttgggtgagggtggcttgaaagtcatcaaaatccacgaagcggtggtaagccccggtattaatggtgtaagcacagttggccatgactgaccagttaactgtctggtgaccagggcgcacgagctcggtgtatttaagtcgcgaataggcgcgggtgtcaaagatgtaatcgttgcaggtgcgcaccagatactggtaccctataagaaaatgtggcggtggttggcggtagagaggccatctttctgtagctggagcgccgggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggtacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggttgccgaatggcagggaagtgagtcctattttttttttttgccgctcagatgcatcccgtgctgcgacagatgcgtccccaacaacagcccccctcgcagcagcagcagcaaccacaaaaggctgtccctgcaactactgcaactgccgccgtgagcggtgcgggacagcccgcctatgatctggacttggaagagggcgaaggactggcacgtctaggtgcgccttcgcccgagcggcatccgcgagttcaactgaaaaaagattctcgcgaggcatatgtgccccaacagaacctatttagagacagaagcggcgaggagccggaggaaatgcgagcttcccgctttaacgcgggtcgtgagctgcgtcacggtttggatcgaagacgagtgttgcgggacgaggattttgaagttgatgaagtgacagggatcagtcctgccagggcacacgtggctgccgccaaccttgtatcggcttacgagcagacagtaaaggaagagcgtaactttcaaaagtcttttaataatcatgtgcgaacactgattgcccgcgaagaggtcacccttggtttgatgcatttgtgggatttgatggaagctatcattcagaaccctactagcaaacctctgaccgcgcagctgtttctggtggtgcaacacagcagagacaatgaggctttcagagaggcgcttctcaacatcaccgaacccgaggggagatggttgtatgatcttatcaacattctacaaagtatcatagtgcaggagcggagcctgggcctggccgagaaggtggctgccatcaattactcggttttgagcttgggaaaatattacgctcgcaagatctacaaaactccatatgttcccatagacaaggaggtgaagatagatgggttctacatgcgtatgacgctgaaggtgctgaccctgagcgatgatcttggggtgtaccgcaatgacagaatgcatcgcgcggttagcgccagcaggaggcgcgagttaagcgacagggaactgatgcacagtttgcaaagagctctgactggagctggaaccgagggtgagaattactttgacatgggagctgacttgcagtggcagcctagtcgcagggctctgagcgccgctacgacaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaacgtgcaaaccaatttggaccgtatgataacagatgtacgcgaagctgtgtctcagcgcgaaaggttccagcgcgatgccaacctgggttcgctggtggcgttaaatgcttttttgagtactcagcctgctaatgtgccgcgcggtcaacaggattatactaactttttgagtgcattgagactgatggtatctgaagtacctcagagcgaagtgtatcagtccggacctgactacttctttcagactagcagacagggcttgcagacggtaaatctgagccaagcttttaaaaaccttaaaggtttgtggggagtgcatgccccggtaggagaaagagcaaccgtatctagcttgttaactccgaactcccgcctattactactgttggtagctcctttcaccgacagcggtagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcgatctcagaagatccctcctcaatatgctcttactgcagaggaggagaggatccttagatatgtgcagcagagtgtgggattgtttctgatgcaagagggggcaactccgactgcagcactggacatgactgcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacgggtttctgtgggacgacgtggacagcgatgttttttcacctctttctgatcatcgcgcgtggaaaaaggaaggcggcgatagaatgcattcttctgcatcgctgtccggggtcatgggtgctaccgcggctgagcccgagtctgcaagtccttttcctagtctacccttttccctacacagtgtacgtagcagcgaagtgggtaggataagtcgcccgagtttaatgggcgaagaggagtacctaaacgattccttgctcagaccggcgagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtgttggacttgggtgggagaggaaggggcaacccgtttgctcatttgcgccctcgcttgggtggtatgttgtaaaaaaaaaaataaaaagaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagactattaactttgatgaacgatcgcggtggggcggtcagctaaagaccatcatgcatactaatatgccaaacgtgaacgagtatatgtttagtaacaagttcaaagcgcgtgtgatggtgtccagaaaagctcctgaaggtgttacagtagacaataattatgatcataagcaagatattctaaaatacgagtggttcgagttcactttgccagagggcaacttttcggtcactatgactattgacttgatgaacaatgccatcatagacaactacttaaaagttggcagacagaatggagtgctggaaagtgacatcggtgttaagttcgacaccaggaacttcaagctgggatgggatcccgaaaccaagttgatcatgcctggagtgtatacgtatgaagccttccatcctgacattgttttactgcctggctgcggagtggactttaccgagagtcgtttgagcaaccttcttggtatcagaaaaaaacagccattccaagagggttttaagatcttgtatgaagatttagaaggtggtaatattccggctctcttggatgtagatgcctatgagaacagtaagaaagaacaaaaagccaaaatagaagctgctatagctgctgcagaagctaaggcaaacatagttgccagcgactctacaagggttgctaacgctggagaggtcagaggagacaattttgcgccaacacctgttccgactacagaatcattattggccgatatgtctgaaggaacggacgtaaaactcactattcaacctgtagaaaaagatagtaagaatagaagctataatgtgttggaagataaaatcaacacagcctatcgcagttggtacctttcgtacaattatggcgaccccgaaaaaggagtgcgttcctggacattgctcaccacctcagatgtcacctgcggagcggagcaggtctactggtcgcttccagacatgatgcaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaatgtccattcttatctcacccagtaataacaccggttggggtctgcgcgctcccagcaagatgtacggaggcgcacgcaaacgttctacccaacatcccgtgcgtgttcgcggtcattttcgcgctccatggggtgccctcaagggccgcactcgcgttcgaaccaccgttgatgatgtaatcgatcaggtggttgccgacgcccgtaattatactcctactgcgcctacatctactgtggacgcagttattgacagtgtagtggctgacgctcgcaactatgctcgacgtaagagccgacgaaggcgcattgccagacgtcaccgagctaccactgccatgcgagccgcaagagctctgctacgaagagctaggcgcgtggggcgaagagccatgcttagggcggccagacgtgcagcttcgggcgccagcgccggcaggtcccgcaggcaagctgccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcgcctgaagtctacggccaaccgttgaaggatgaaaaaaaaccccgcaaaatcaagcgggtaaaaaaggacaaaaaagaagaggaagatggcgatgatgggctggcggagtttgtgcgcgagtttgccccacggcggcgcgtgcaatggcgtggacgcaaagttcgacatgtgttgagacctggaacttcggtggtctttacacccggcgagcgttcaagcgctacttttaagcgttcctacgatgaggtgtacggggatgatgatattcttgagcaggcagctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactgatggtgcccaaacgccagaagttggaggacgttttggagaaagtaaaagtggatccagatattcaacctgaggttaaagtgagacccattaagcaggtagcgcctggtctaggagtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacatccatctattattcctactcctggttaccgaggcactcgctactatcgcagccgaaacagtacctcccgccgtcgccgcaagacacctgcaaatcgcagtcgtcgccgcagacgcacaagcaaaccgactcccggcgccctggtgcggcaagtgtaccgcaatggtagtgcggaacctttgacactgccgcgcgcgcgttaccatccgagtatcgtcacttaatcaatgttgccgctgcctccttgcagatatggccctcacttgtcgccttcgcgttcccatcactggttaccgaggaagaaactcgcgccgtagaagagggatgttggggcgcggaatgcgacgctacaggcgacggcgtgctatccgcaagcaattgcggggtggttttttgccagccttaattccaattatcgctgctgcgattggcgcaataccaggcatagcttccgtggcggttcaggcctcgcaacgacattgacattggaaaaaaaaaaaacgtataaataaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagatcagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccaccagaccgatagcccctatggccaccggggtgatgaaaccttctcagttgcatcgacccgtcaccttggatttgccccctccccctgctgctactgctgtacccgcttctaagcctgtcgctaccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgatcgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactccctggctcctaaaggcgctccaaatacatctcagtggattgcagaaggtgtaaaaaatacaactggtagaaatggtgaggaagacgtaacagaagaggaaaccaatactgctacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaactgaaaagtatggaggcagggctctcaaacccgatactaagatgaaaccatgctacgggtcctttgccaaacctactaatgtgaaaggcggtcaggcaaaaccaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacagtctatgcccaacagacccaactacattggcttcagagataactttatcggacttatgtactataacagtactggtaacatgggggtgctggctggtcaagcgtctcagttaaatgcagtggttgacttgcaggacagaaacacagaactgtcttaccaactcttgcttgactctctgggcgacagaaccagatactttagcatgtggaatcaggctgtggacagttatgatcctgatgtacgtgttattgaaaatcatggtgtggaagatgaacttcccaactattgttttccactggacggcataggtgttccaacaaccagttacaaatcaataattccaaatggagacaatgcacctaattggaaggaacctgaagtaaatggaacaagtgagatcggacagggtaatttgtttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccgttcaaccaccaccgtaacgccggcttgcgttaccgatccatgcttctgggtaacggacgttatgtgcctttccacatacaagtgcctcaaaaatttttcgctgttaaaaacctgctgcttctcccaggctcctacacttatgagtggaactttaggaaggatgtgaacatggttctacagagttccctcggtaacgacctgcgggtagatggcgccagcatcagttttacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaattgggcggctttcagaggctggtcatttaccagactcaaaaccaaagaaactccctctttggggtctggatttgacccctactttgtctattctggttctattccctacctggacggtaccttctacctgaaccacacttttaagaaggtttccatcatgtttgactcttcagtgagctggcctggaaatgacaggttactatctcctaacgaatttgaaataaagcgtactgtggatggcgaaggctacaacgtagcccaatgcaacatgaccaaagactggttcttggtacagatgctcgccaactacaacatcggctatcagggcttttacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatccagctaactatccctatccactcattggaacaactgccgtaaatagtgttacgcagaaaaagttcttgtgcgacagaaccatgtggcgcataccgttctcgagcaacttcatgtctatgggggcccttacagacttgggacagaacatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaacagcagctgcaaccatggcctgcggatcccaaaacggctccagcgagcaagagctcagagccattgtccaagacctgggttgcggaccctattttttgggaacctttgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggcccccgttctgccgcctgcggactattctgctgcatgttccttcacgcctttgtgcactggcctgaccgtcccatggacggaaaccccaccatgaaattgctaactggagtgccaaacaacatgcttcattctcctaaagtccagcccaccctgtgtgacaaccaaaaagcactctaccattttctcaatacccattcgccttattttcgctctcatcgtacacacatcgaaagggccactgcgttcgaccgtatggatgtgcaataatgactcatgtaaacaacgtgttcaataaacatcactttattttttacatgtatcaaggctctggattactttttatttacaagtcgaatgggttctgacgagaatcagaatgacccgcaggcagtgatacgttgcggaattgatacttgggttgccacttgaattcgggaatcaccaacttgggaaccggtatatcgggcaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatagcgggcacccaattaggcttgtggttacaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccgttctcgctggccacatccatctcgataatctgctccttctgaatcataatattgccatgcaggcacttcagcttgccctcataatcattgcaaccatgaggccacaacgcacagcctgtacattcccaattatggtgggcgatctgagaaaaagaatgtatcattccctgcagaaatcttcccatcatggtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcacacacatcacttccatgcctttctcccaagcagacaccaggggcaagctaatcggattcttaacagtgcaggcagcagctcctttagccagagggtcatctttggcgatcttctcaatgcttcttttgccatccttctcaacgatgcgcacgggcgggtagctgaaacccactgctacaagttgcgcctcttctctttcttcttcgctgtcttgactgatgtcttgcatggggacatgtttggtcttccttggcttctttttggggggtatcggaggaggaggactgtcgctccgttccggagagagggaggattgtgaagtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagctcaacctcttttcacctcgtactccccccaaacgccagccaaacggcacctgtgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaacgctctgcaaaagggagaaaatggcatggatgagcatcacagcgttctggtggaattggagggcgataatgccagactcgcagtactcaagcgaagcgtcgaggtcacacactttgcataccccgctgtcaacctgccccctaaagtcatgacggccgtcatggaccagttactcattaagcgcgcaagtcccctttcagaagacatgcatgacccagatgcctgtgacgagggtaaaccagtggtcagtgatgagcagctaacccgatggctgggcaccgactctccccgggatttggaagagcgtcgcaagcttatgatggccgtggtgctggttaccgtagaactagagtgtctccggcgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcagggccccagcagccaaggcgatgggtcttctcctgggcaaagtttaaaactgaccccgggactgtggacctccgcctacttgcgcaagtttgccccggaagattaccacccctatgaaatcaagttctatgaggaccaatcacagcctccgaaggccgaactttcggcctgcgtcatcacccagggggcaattctggcccaattgcaagccatccaaaaatcccgccaagaatttctactaaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcgacgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaacacacaacaagtgcagcaacaggaggattaaagattgcagccaacgagccagcgcaaacccgagagttaagaaatcggatctttccaaccctgtatgccatcttccagcagagtcggggccaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgtcatgagtaaagaaattcccacgccttacatgtggagttaccagccccaaatgggattggcggcaggcgcctcccaggactactccacccgcatgaattggctcagcgccgggccctctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcaaattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggattactatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgctttttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccacggtctccctacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggactgcaggtccgttgaaattacacacaataacaaaacctggaacaataccttatccaccacatgggagccaggagttcccgagtggtacactgtctctgtccaaggtcctgacggttccatccgcattagtaacaacactttcattttttctgaaatgtgcgatttggccatgttcatgagcaaacagtattctctatggcctcccaacaaggacaacatcgtaacgttctccattgcttattgcttgtgcgcttgcctccttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcacggacaaacagtcgtctctatccctctaggacataattacactctcataggacccccaatcacttcagaggtcatctggaccaaattgggaagcgttgattactttgatataatctgcaacaaaacaaaaccaataatagtaacttgcaacatacaaaatcttacattaattaatgttagcaaagtttacagcggttactattatggttatgacagatacagtagtcaatatagaaattacttggttcgtgttacccagttcaaaaccacaaaaatgccaaatatggcaaagattcgatccgatgacaattctctagaaacttttacatctcccaccacacctgacgaaaaaaacatcccagattcaatgattgcaattatcgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggttcaaactgcacactaaaaggacctcaaggcggccatgtcttttggtggagaatatatgacaatggatggtttacaaaaccatgtgaccaacctggtcgatttttctgcaacggcagagacctaaccattgtcaacgtgacagcaagtgacaaaggcttctattatggaaccgactatcaaactagtttagattataacattattgtactgccatccaccactccagcaccccgcaaaactactttctctagcagcagtgccgctaacaatacaatttccaatccaacctttgccgcgcttttaaaacgcactgtgaataattctacaacttcacatacaacaatttccatttcaacaatcagcattattgctgccgtgacaattggaatatctattcttgtttttaccataacctactacgcctgctgctatagaaaagacaaacataaaggtgatccattacttagatttgatatttaatttgttcttttttttatttacagtatggtgaacaccaatcatggtacctagaaatttcttcttcaccatactcatctgtgcttttaatgtttgcgctactttcacagcagtagccacagcaaccccagactgtataggagcatttgcttcctatgcactttttgcttttgtcacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgctcccctacgctgtctcaactccagctgcctatagtactccgccagaacaccttagaaaatgcaaattccaacaaccgtggtcatttcttgcttgctatcgagaaaaatcagaaattcccccaaatttaataatgattgctggaataattaatataatctgctgcaccataatttcatttctgatataccccctatttgattttggctggaatgctcccaatgcacatgatcatccacaagacccagaggaacacattcccctacagaacatgcaacatccaatagcgctaatagaatacgaaagtgaaccacaacccccactactccctgctattagttacttcaacctaaccggcggagatgactgaaacactcaccacctccaattccgccgaggatctgcttgatatggacggccgcgtctcagaacagcgactcgcccaactacgcatccgccaacagcaggaacgcgtggccaaagagctcagagatgtcatccaaattcaccaatgcaaaaaaggcatattctgtctggtaaaacaagccaagatatcctacgagatcaccgctactgaccatcgcctctcttatgagcttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggtctaagagacctgctaccaatgaattaaaaaaaatgattaataaaaaatcacttacttgaaatcagcaataaggtctctgttgaaattttctcccagcagcacctcacttccctcttcccaactctggtattctaaaccccgttcagcggcatactttctccatactttaaatgggatgtcaaattttagctcctctcctgtacccacaatcttcatgtctttcttcccagatgaccaagagagtccggctcagtgactccttcaaccctgtctatccctatgaagatgaaagcacctcccaacacccctttataaacccagggtttatttccccaaacggcttcacacaaagcccagacggagttcttactttaaaatgtttaaccccgctaacaaccacaggcgggtctctacagttaaaagtgggagagggtcttacagtagatgacaccgggtttttgaaagaaaacataagtgctaccacaccactcgttaagactggtcactctataggtttgtcgctaggacccggattaggaacaaatgaaaataaactttgtaccaaattgggagaaggacttacattcaattcgaacaacatttgcattgatgacaatattaacaccctatggacaggagttaaccccaccagagccaactgtcaaatgatggactccagtgaatctaatgattgcaaattaattctaacactagttaaaactggagccctagttactgcatttgtttatgttataggagtatctaacgattttaatatgctaactacacagaaaaatataaattttactgcagagctgtttttcgattctactggtaatttactaactagcctctcatccctaaaaactccacttaatcataaatcagggcaaaacatggctactggtgccattactaatgctaaaggtttcatgcccagcacaactgcctatcctttcaataataattccagagaaaaagaaaactacatttacggaacttgttactacacagctagtgatcacactgcttttcccattgacatatctgtcatgcttaaccgaagagcaataaatgatgagacatcatattgtattcgtataacttggtcctggagcacaggagttgccccagaagtgcaaacctctgctactaccctagtcacctctccatttaccttttactacatcagagaagacgactgacaaataaagtttaacttgtttatttgaaaatcaattcacaaaattcgagtagttattttgcctcccccttcccatttaacagaatacaccaatctctccccacgcacagctttaaacatttggataccattagagatagacatagttttagattccacattccaaacagtttcagagcgagccaatctggggtcagtgatacataaaaatgcatctggatagtcttttaaagcgctttcacagtccaactgctgcggatgcgactccggagtctgaatcacggtcatctggaagaagaacgatgggaatcataatccgaaaacgggatcgggcgattgtgtctcatcaaacccacaagcagccgctgtctgcgtcgctccgtgcgactgctgtttatgggatcggggtccacagtgtcctgaagcataattttaatagcccttaacattaactttctggtgcgatgcgcgcagcaacgcattctgatctcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtagcacaacatagacataaatgcatgcatcttctcataatttttaactcctcaggatttagaaacatatcccagggaataggaagctcttgcagaacagtaaa

SEQ ID NO: 1427 - DNA, 32767 bp, Human mastadenovirus B
gtggtgattggctgtggggttaacggctaaaaggggcggcgcggccgtgggaaaatgatgttttttgggggtggagttttttttgcaagttgtcgcgggaaatgtgacgtgcacaaaggcttttttctcacggaactacttagttttcccacggtatttaacaggaaatgaggtacttttggccggatgcaagtgaaaactgttcattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctaatgggagacgatccggagccacctgtgcagctttttgagcctcctacgcttcaggaactgtatgatttagaggtagagggatcggaggattctaatcaggaagctgtgaatggcttttttaccgattctatgcttttagctgctaatgaaggattagaattagatccgcctttggacacttttgatattccaggggtgattgtggaaagcggtacaggtgtaagaaaattacctgatttgggttccgtggactgtgatttgcactgctatgaagacgggtttcctccgagtgatgaggaggaccatgaaaaggagcagtctatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaacttaaaatttaaaggaatatgctgtttttcacatgtatattgagtgggagttttgtgtttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgagagtgcaatgtaataaaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttggagaacgcttcggacggagtctccggtttttggagattctggttcgctagtgaattagctagggtagtttttaggataaaacaggactataaagaagaatttgaaaagttgttggtagattgcccaggactttttgaagctcttaatttgggccaccaggttcactttaaagaaaaagttttatcagttttagacttttcaaccccaggtagaactgccgctgctgtggcttttcttacttttatattagacaaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccacctgtcatgccagcggttctggaggaggaacagcaagaggacaatccgagagccggcctggaccctccagtggaggaggcggagtagctgacttgtctcctgaactgcaacgggtgcttactggatctacgtccactggacgggataggggcgttaagagggagagggcatccagtggtactgatgctagatctgagttggctttaagtttaatgtctcgcagacgtcctgaaaccatttggtggcatgaggttcagaaagagggaagggatgaagtttctgtattgcaggagaaatattcactggaacaggtgaaaacatgttggttggagccagaggatgattgggaggtggccattaaaaattatgcgaagatagctttgaggcctgataagcagtataagatcactagacggattaatatccggaatgcttgttacatatctggaaatggggctgaggtggtaatagatactcaagacaagacagttattagatgctgcatgatggatatgtggcctggagtagtcggtatggaagcagtcacttttgtaaatgttaagtttaggggagatggttataatggaatagtgtttatggccaataccaaacttatattgcatggttgtagcttttttggtttcaacaatacctgtgtagatgcctggggacaggttagtgtgcgggggtgtagtttctatgcgtgttggattgccacagcaggcagaaccaagagtcaattgtctctgaagaaatgcatattccaaagatgtaacctgggcattctgaatgaaggcgaagcaagggtccgccactgcgcttctacagatactggatgttttattttaattaagggaaatgccagcgtaaagcataacatgatttgcggtgcttccgatgagaggccttatcaaatgctcacttgtgctggtgggcattgtaatatgctggctactgtgcatattgtttcccaccaacgcaaaaaatggcctgtttttgatcacaatgtgttgaccaagtgcaccatgcatgcaggtgggcgtagaggaatgtttatgccttaccagtgtaacatgaatcatgtgaaagtgttgttggaaccagatgccttttccagaatgagcctaacaggaatctttgacatgaacacgcaaatctggaagatcctgaggtatgatgatacgagatcaagggtgcgcacatgcgaatgcggaggcaagcatgccaggttccagccggtgtgtgtagatgtgacggaagatctcagaccggatcatttggttattgcccgcactggagcagagttcggatccagtggagaagaaactgactaaggtgagtattgggaaaagtttggggtgggattttcagatagacagattgagtaaaaatttgttttttctgtcttgcagctgtcatgagtggaaacgcttcttttaaggggggagtcttcagcccttatttgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgccgcctctgtcgccgctaacactgtgcttggaatgggttactatggaagcatcgtggctaattccacttcctctaataacccttctaccctgactcaggacaagttacttgtccttttggcccagctggaggctttgacccaacgtctgggtgaactttctcagcaggtggcggagttgcgagtacaaactgagtctgctgtcggcacggcaaagtctaaataaaaaaattccagaatcaatgaataaataaacgagcttgttgttgatttaaatcaagtgtttttatttcatttttcgcgcacggtatgccctagaccaccgatctcgatcattgagaactcggtggattttttccagaatcctatagaggtgggattgaatgtttagatacatgggcattaggccatctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcgatattgccgccaagatcccgtcttgggttcatgttatgaaggaccaccaagacggtgtatccggtacatttaggaaatttatcatgtagcttggatggaaaagcgtggaaaaatttggagacacccttgtgtcctccgagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagtttccctcacagatttgcatttcccaagctttcagttccgagggtggaatcatgtccacctggggggctatgaaaaacaccgtttctggggcgggggtgattagttgggatgatagcaaatttctgagcaattgagatttgccacatccggtggggccatatatgattccgattacaggttgcagatggtagtttagggagcggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtttgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcattctgctggtcgagaacttctgtcgcttggcgccctgtatgtcggccaagtagcagtttaccatgagttcgtagttgagcgcctcggctgcgtggcctttggcgcgtagcttacctttggaagttttcttgcataccgggcagtataggcatttcagcgcatacagcttgggcgcgaggaaaatggattctggggagtatgcatccgcaccgcaggaggcgcaaacagtttcacattccaccagccaggttaaatccggttcattggggtcaaaaacaagttttccgccatattttttgatgcgtttcttacctttgctctccataagttcgtgtcctcgttgagtgacaaacaggctgtccgtgtccccgtagactgattttacaggcctcttctccagtggtgtgcctcggtcttcttcgtacagaaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgccaggcacttccattcggggaagatagttgtcaattcatctggcacgattctcacttgccaccctcgattatgcagggtaattaaatccacactggtggccacctcgcctcgaaggggttcgttggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaagaggactgccccagggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtacgattgggtttttctgttctgtagacaatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtccagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgagaaattggtatttgaagtccatgtcgtcacaggctccctgttcccagagttggaagtctacccgtttcttgtaggcggggttgggcaaagcgaaagtaacatcgttgaagagaatcttgccggctctgggcataaaattgcgagtgatgcggaaaggctgtggtacttccgctcgattgttgatcacctgggcagctaggacgatctcgtcgaaaccgttgatgttgtgtcctacgatgtataattctatgaaacgcggcgtgcctctgacgtgaggtagcttattgagctcatcaaaggttaggtctgtagggtcagataaggcgtagtgttcgagagcccattcgtgcaggtgaggatttgcatggaggaatgttgaccaaagatccaccgccagtgctgtttgtaactggtcccgatactgacgaaaatgttggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccaaacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgggggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcaatctccgccatgaactgctcgatttcttcctcctgaagatctccgcgacccgctctctcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaagtacatgatccatcgtctcagcggcatttcgctgacatcgcccagagcttccaagcgctccatggcctcgtagaagtccacggcgaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcctcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagagagagggcgctgattatacattttattaattggcccgtagggactgcgcgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctattccttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaacccgcgcattggttgaaccagtgccaagtcagctacgactctttcggcgaggatggcttgctgtacttgggtgagggtggcttgaaagtcatcaaaatccacgaagcggtggtaagccccggtattaatggtgtaagcacagttggccatgactgaccagttaactgtctggtgaccagggcgcacgagctcggtgtatttaagtcgcgaataggcgcgggtgtcaaagatgtaatcgttgcaggtgcgcaccagatactggtaccctataagaaaatgtggcggtggttggcggtagagaggccatctttctgtagctggagcgccgggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggtacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggttgccgaatggcagggaagtgagtcctatttttttttttttgccgctcagatgcatcccgtgctgcgacagatgcgtccccaacaacagcccccctcgcagcagcagcagcaaccacaaaaggctgtccctgcaactactgcaactgccgccgtgagcggtgcgggacagcccgcctatgatctggacttggaagagggcgaaggactggcacgtctaggtgcgccttcgcccgagcggcatccgcgagttcaactgaaaaaagattctcgcgaggcatatgtgccccaacagaacctatttagagacagaagcggcgaggagccggaggaaatgcgagcttcccgctttaacgcgggtcgtgagctgcgtcacggtttggatcgaagacgagtgttgcgggacgaggattttgaagttgatgaagtgacaggaatcagtcctgccagggcacacgtggctgccgccaaccttgtatcggcttacgagcagacagtaaaggaagagcgtaactttcaaaagtcttttaataatcatgtgcgaacactgattgcccgcgaagaggtcacccttggtttgatgcatttgtgggatttgatggaagctatcattcagaaccctactagcaaacctctgaccgcgcagctgtttctggtggtgcaacacagcagagacaatgaggctttcagagaggcgcttctcaacatcaccgaacccgaggggagatggttgtatgatcttatcaacattctacaaagtatcatagtgcaggagcggagcctgggcctggccgagaaggtggctgccatcaattactcggttttgagcttgggaaaatattacgctcgcaagatctacaaaactccatacgttcccatagacaaggaggtgaagatagatgggttctacatgcgcatgacgctgaaggtgctgaccctgagcgatgatcttggggtgtaccgcaatgacagaatgcatcgcgcggttagcgccagcaggaggcgcgagttaagcgacagggaactgatgcacagtttgcaaagagctctgactggagctggaaccgagggtgagaattactttgacatgggagctgacttgcagtggcagcctagtcgcagggctctgagcgccgctacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaacgtgcaaaccaatttggaccgtatgataacagatgtacgcgaagctgtgtctcagcgcgaaaggttccagcgcgatgccaacttgggttcgctggtggcgttaaatgcttttttgagtactcagcctgctaatgtgccgcgcggtcaacaggattatactaactttttgagtgcattgagactgatggtatctgaagtacctcagagcgaagtgtatcagtccggacctgactacttctttcagactagcagacagggcttgcagacggtaaatctgagccaagcttttaaaaaccttaaaggtttgtggggagtgcatgccccggtaggagaaagagcaaccgtatctagcttgttaactccgaactcccgcctattactactgttggtagctcctttcaccgacagcggtagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcgatctcagaagatccctcctcaatatgctcttactgcagaggaggagaggatccttagatatgtgcagcagagtgtgggattgtttctgatgcaagagggggcaactccgactgcagcactggacatgactgcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacgggtttctgtgggacgacgtggacagcgatgttttttcacctctttctgatcatcgcgcgtggaaaaaggaaggcggcgatagaatgcattcttctgcatcgctgtccggggtcatgggtgctaccgcggctgagcccgagtctgcaagtccttttcctagtctacccttttccctacacagtgtacgtagcagcgaagtgggtaggataagtcgcccgagtttaatgggcgaagaggagtacctaaacgattccttgctcagaccggcgagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtgttggacttgggtgggagaggaaggggcaacccgtttgctcatttgcgccctcgcttgggtggtatgttgtaaaaaaaaataaaaagaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagactattaactttgatgaacgatcgcggtggggcggtcagctaaagaccatcatgcatactaatatgccaaacgtgaacgagtatatgtttagtaacaagttcaaagcgcgtgtgatggtgtccagaaaagctcctgaaggtgttacagtagacaataattatgatcataagcaagatattctaaaatacgagtggttcgagttcactttgccagagggcaacttttcggtcactatgactattgacttgatgaacaatgccatcatagacaactacttaaaagttggcagacagaatggagtgctggaaagtgacatcggtgttaagttcgacaccaggaacttcaagctgggatgggatcccgaaaccaagttgatcatgcctggagtgtatacgtatgaagccttccatcctgacattgttttactgcctggctgcggagtggactttaccgagagtcgtttgagcaaccttcttggtatcagaaaaaaacagccattccaagagggttttaagatcttgtatgaagatttagaaggtggtaatattccggctctcttggatgtagatgcctatgagaacagtaagaaagaacaaaaagccaaaatagaagctgctatagctgctgcagaagctaaggcaaacatagttgccagcgactctacaagggttgctaacgctggagaggtcagaggagacaattttgcgccaacacctgttccgactacagaatcattattggccgatatgtctgaaggaacggacgtaaaactcactattcaacctgtagaaaaagatagtaagaatagaagctataatgtgttggaagataaaatcaacacagcctatcgcagttggtacctttcgtacaattatggcgaccccgaaaaaggagtgcgttcctggacattgctcaccacctcagatgtcacctgcggagcggagcaggtctactggtcgcttccagacatgatgcaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaatgtccattcttatctcacccagtaataacaccggttggggtctgcgcgctcccagcaagatgtacggaggcgcacgcaaacgttctacccaacatcccgtgcgtgttcgcggtcattttcgcgctccatggggtgccctcaagggccgcactcgcgttcgaaccaccgttgatgatgtaatcgatcaggtggttgccgacgcccgtaattatactcctactgcgcctacatctactgtggacgcagttattgacagtgtagtggctgacgctcgcaactatgctcgacgtaagagccgacgaaggcgcattgccagacgtcaccgagctaccactgccatgcgagccgcaagagctctgctacgaagagctagacgcgtgggacgaagagccatgcttagggcggccagacgtgcagcttcgggcgccagcgccggcaggtcccgcaggcaagctgccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcgcctgaagtctacggccaaccgttgaaggatgaaaaaaaaccccgcaaaatcaagcgggtaaaaaaggacaaaaaagaagaggaagatggcgatgatgggctggcggagtttgtgcgcgagtttgccccacggcggcgcgtgcaatggcgtggacgcaaagttcgacatgtgttgagacctggaacttcggtggtctttacacccggcgagcgttcaagcgctacttttaagcgttcctacgatgaggtgtacggggatgatgatattcttgagcaggcagctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactgatggtgcccaaacgccagaagttggaggacgttttggagaaagtaaaagtggatccagatattcaacctgaggttaaagtgagacccattaagcaggtagcgcctggtctgggagtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacatccatctattattcctactcctggttaccgaggcactcgctactatcgcagccgaaacagtacctcccgccgtcgccgcaagacacctgcaaatcgcagtcgtcgccgcagacgcacaagcaaaccgactcccggcgccctggtgcggcaagtgtaccgcaatggtagtgcggaacctttgacactgccgcgtgcgcgttaccatccgagtatcgtcacttaatcaatgttgccgctgcctccttgcagatatggccctcacttgtcgccttcgcgttcccatcactggttaccgaggaagaaactcgcgccgtagaagagggatgttggggcgcggaatgcgacgctacaggcgacggcgtgctatccgcaagcaattgcggggtggttttttgccagccttaattccaattatcgctgctgcgattggcgcaataccaggcatagcttccgtggcggttcaggcctcgcaacgacattgacattggaaaaaaaaacgtataaataaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagatcagaacttccaacaaaaagtagtcgatgggatagcttccggcatcaatggagtggtagatttggctaaccaggctgtgcaaaaaaagataaacagtcgtttggacccgccgccagcaaccccaggtgaaatgcaagtggaggaagaaattcctccaccagaaaaacgaggcgacaagcgtccgcgtcccgatttggaagagacgctggtgacgcgcgtagatgaaccgccttcttatgaggaagcaatgaagcttggaatgcccaccaccagaccgatagcccctatggccaccggggtgatgaaaccttctcagttgcatcgacccgtcaccttggatttgccccctccccctgctgctactgctgtacccgcttctaagcctgtcgctaccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatcttggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccttattctggcacggcttacaactccctggctcctaaaggcgctccaaatgcatctcagtggttggataagggagttacaagcactggtctagtggacgacgggaatggtgatgatggggaagaagccaaaaaagcaacatacacttttggtaatgctccagtaaaagccgaggctgaaatcacaaaagacggattgccggtgggcttggaagtttcaactgaaggtcctaaaccaatctatgctgataagctttatcagccagaacctcaagtgggagacgaaacttggactgacctagacggaaaaaccgaagagtatggagggagggttcttaaacctgaaactaaaatgaaaccctgctacggatcttttgctaaacctactaatattaaaggaggtcaggcaaaggtaaaaccaaaagaagacgatggcactaacaacatcgaatatgacattgacatgaacttctttgacttaagatcacaaagatcagaactgaaacctaaaattgtaatgtatgcagaaaatgtggacctggaatctccagatactcatgttgtgtacaaacctggagtttcagatgctagttctgagaccaatcttggacaacagtctatgcccaacagacccaactacattggcttcagagataactttatcggacttatgtactataacagtactggcaacatgggggtattggctggccaagcgtctcagttgaatgcagtggttgacttgcaggacagaaacacagaactgtcttaccaactcttgcttgactccctgggcgacagaaccagatactttagcatgtggaatcaggctgtggacagttatgatcctgatgtacgtgttattgaaaatcatggtgtggaagatgaacttcccaactattgttttccgttggatggtgtcggtccgcgaacagatagttacaaggagattaaaccaaatggagaccaatctacttggacgaatgtagacccgaatggcagcagtgaacttgctaagggaaatccatttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggcgccaggtggtctctggatgccatggacaatgtgaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaatgacctgcgggtagatggcgccagcatcagtttcacgagcatcaacctctatgctacttttttcccaatggctcacaacaccgcttccacccttgaagccatgctgcggaatgacaccaatgatcagtcattcaacgactacctatctgcagctaacatgctctaccccattcctgccaatgcaaccaatattcccatttcaattccttctcgcaactgggcggctttcagaggctggtcatttaccagactgaaaaccaaagaaactccctctttggggtccggatttgacccatactttgtctattctggttctattccctacctggatggtaccttctacctgaaccacacttttaagaaggtttccatcatgtttgactcttcagtgagctggcctggaaacgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaagtcaattacaaagacttcaaggccgtcgccataccctaccaacacaacaactctggctttgtgggttacatggctccgactatgcgccaaggtcaaccctatcccgctaactatccctatccactcatcggaactactgccgtaaatagtgttacgcagaaaaagttcttgtgtgacagaaccatgtggcgcataccgttctccagcaacttcatgtctatgggggcccttacagacttggggcagaacatgctctatgccaactcagctcatgctctggacatgaccttcgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaacagcagctgcaaccatggcctgcggatcccaaaacggctccagcgagcaagagctcagagccattgtccaagacctgggttgcggaccctattttttgggaacctacgataagcgcttcccggggttcatggctcccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggcccccgttccgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactttatcattttctcaatacccattcgccttattttcgctctcatcgcacacacatcgaaagggccactgcgtttgaccgtatggatgtgcaataatgattcatgtaaacaacgtgttcaataaacagcactttattttttacatgtatcaaggctctggattacttatttatttacaagtcgaatgggttctgacgagaatcagaatgacccgcaggcagtgatacgttgcggaactgatacttgggttgccacttgaattcgggaatcaccaacttcggaaccggtatatcgggcaggatgtcactccacagctttctagtcagctgcaaagctcccagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttacaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccgttctcgctggccacatccatctcgataatctgctccttctgaatcataatattgccatgcaagcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttggcgatcttctcaatgcttcttttgccatccttctcaacgatgcgcacgggcgggtagctgaaacccactgctacaagttgcgcctcttctctttcttcttcgctgtcttgactgatgtcttgcatggggacatgtttggtcttccttggcttctttttggggggtatcggaggaggaggactgtcgctccgttccggagacagggaggattgtgaagtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagctcaacctcttttcacctcgtactccccccaaacgccagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggagggcgataatgccagactcgcagtactcaagcgaagcgtcgaggtcacacactttgcatatcccgctgtcaacctgccccctaaagtcatgacggccgtcatggaccagttactcattaagcgcgcaagtcccctttcagaagacatgcatgacccagatgcctgtgatgagggtaaaccagtggtcagtgatgagcaactaacccgatggctgggcaccgactctccccgggatttggaagagcgtcgcaagcttatgatggccgtggtgctggttaccgtagaactagagtgtctccggcgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcagggccccagcagccaaggcgatgggtcttctcctgggcaaagtttaaaactgaccccgggactgtggacctccgcctacttgcgcaagtttgccccggaagattaccacccctatgaaatcaagttctatgaggaccaatcacagcctccgaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcgacgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaacacacaacaagtgcagcaacaggaggattaaagattgcagccaacgagccagcgcaaacccgagagttaagaaatcggatctttccaaccctgtatgccatcttccagcagagtcggggccaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgtcatgagtaaagaaattcccacgccttacatgtggagttaccagccccaaatgggattggcggcaggcgcctcccaggactactccacccgcatgaattggctcagcgccgggccctctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagcttaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggattactatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccacggtctccctacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggactgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcccagcaaggacaacattgtaacgttctccattgcttattgcttgtgcgcttgcctccttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcacggacaaacagtcgtctctatccctctaggacataattacactctcataggacccccaatcacttcagaggtcatctggaccaaattgggaagcgttgattactttgatataatctgtaacaaaacaaaaccaataatagtaacttgcaacatacaaaatcttacattaattaatgttagcaaagtttacagcggttactattatggttatgacagatacagtagtcaatatagaaattacttggttcgtgttacccagttcaaaaccacaaaaatgccaaatatggcaaagattcgatccgatgacaattctctagaaacttttacatctcccaccacacctgacgaaaaaaacatcccagattcaatgattgcaattatcgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggttcaaactgcacactaaaaggacctcaaggcggccatgtcttttggtggagaatatatgacaatggatggtttacaaaaccatgtgaccaacctggtcgatttttctgcaacggcagagacctaaccattgtcaacgtgacagcaagtgacaaaggcttctattatggaaccgactatcaaactagtttagattataacattattgtactgccatccaccactccagcaccccgcaaaactactttctctagcagcagtgccgctaacaatacaatttccaatccaacctttgccgcgcttttaaaacgcactgtgaataattctacaacttcacatacaacaatttccatttcaacaatcagcattattgctgccgtgacaattggaatatctattcttgtttttaccataacctactacgcctgctgctatagaaaagacaaacataaaggtgatccattacttagatttgatatttaatttgttctttttttttatttacagtatggtgaacaccaatcatggtacctagaaatttcttcttcaccatactcatctgtgcttttaatgtttgcgctactttcacagcagtagccacagcaaccccagactgtataggagcatttgcttcctatgcactttttgcttttgtcacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgctcccctacgctgtctcaactccagctgcctatagtactccgccagaacaccttagaaaatgcaaattccaacaaccgtggtcatttcttgcttgctatcgagaaaaatcagaaattcccccaaatttaataatgattgctggaataattaatataatctgctgcaccataatttcatttctgatataccccctatttgattttggctggaatgctcccaatgcacatgatcatccacaagacccagaggaacacattcccctacagaacatgcaacatccaatagcgctaatagaatacgaaagtgaaccacaacccccactactccctgctattagttacttcaacctaaccggcggagatgactgaaacactcaccacctccaattccgccgaggatctgcttgatatggacggccgcgtctcagaacagcgactcgcccaactacgcatccgccaacagcaggaacgcgtggccaaagagctcagagatgtcatccaaattcaccaatgcaaaaaaggcatattctgtctggtaaaacaagccaagatatcctacgagatcaccgctactgaccatcgcctctcttatgagcttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggtctaagagacctgctaccaatgaattaaaaaaaatgattaataaaaaatcacttacttgaaatcagcaataaggtctctgttgaaattttctcccagcagcacctcacttccctcttcccaactctggtattctaaaccccgttcagcggcatactttctccatactttaaatgggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaacggcttcacacaaagcccagacggagttcttactttaaaatgtttaaccccgctaacaaccacaggcgggtctctacagttaaaagtgggagagggtcttacagtagatgacaccgggtttttgaaagaaaacataagtgctaccacaccactcgttaagactggtcactctataggtttgtcgctaggacccggattaggaacaaatgaaaataaactttgtaccaaattgggagaaggacttacattcaattcgaacaacatttgcattgatgacaatattaacaccctatggacaggagttaaccccaccagagccaactgtcaaatgatggactccagtgaatctaatgattgcaaattaattctaacactagttaaaactggagccctagtcactgcatttgtttatgttataggagtatctaacgattttaatatgctaactacacagaaaaatataaattttactgcagagctgtttttcgattctactggtaatttactaactagcctctcatccctaaaaactccacttaatcataaatcagggcaaaacatggctactggtgccattactaatgctaaaggtttcatgcccagcacaactgcctatcctttcaataataattccagagaaaaagaaaactacatttacggaacttgttactacacagctagtgatcacactgcttttcccattgacatatctgtcatgcttaaccgaagagcaataaatgatgagacatcatattgtattcgtataacttggtcctggagcacaggagttgccccagaagtgcaaacctctgctactaccctagtcacctctccatttaccttttactacatcagagaagacgactgacaaataaagtttaacttgtttatttgaaaatcaattcacaaaattcgagtagttattttgcctcccccttcccatttaacagaatacaccaatctctccccacgcacagctttaaacatttggataccattagagatagacatagttttagattccacattccaaacagtttcagagcgagccaatctggggtcagtgatagataaaaatgcatctggatagtcttttaaagcgctttcacagtccaactgctgcgggtgcgactccggagtctgaatcacggtcatctggaagaagaacgatgggaatcataatccgaaaacgggatcgggcgattgtgtctcatcaaacccacaagcagccgctgtctgcgtcgctccgtgcgactgctgtttatgggatcggggtccacagtgtcctgaagcataattttaatagcccttaacattaactttctggtgcgatgcgcgcagcaacgcattctgatctcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtagcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtg

SEQ ID NO: 1428 - DNA, 32767 bp, Human mastadenovirus B
catcatcaataatataccttatagatggaatggtgccaatatgtaaatgaggtggtttgaaaatggagagcggaaggggattggcttggggttcaacggtcacggggcggcgcgggaaggtgacgtatgcgtgggtgtggctaagatgcaagctgtcgcggtatttctgacgtaaacgaggtggagtttaaacacggaagtacacagtttcccgcgcttattgacaggaaatgaggtagttttgggcggatgcaagtgaaaattcctcattttcgcgcgaaaactgaatgaggaagtgaatatctgagtaatttcgtgtttatgacagggtggagtatttaccgagggccgagtagactttgaccgattacgtggaggtttcgattaccgtgtttttcacctaaatttccgcgtacggtgtcaaagtcctgtgtttttacgtaggtgtcagctgatcgccagggtatttaaacctgacgagttccgtcaagaggccactcttgagtgccagcgagaagagttttctcctccgcgctgcgagtcagatctccacttcgaaaatgagacacctgcgtttcctgtcccaggagatagtctccactgaaactgggaatgaaatactgcagtttgtggtaaatactctgatgggagacgatccagagccgcctgagccatcttttgatcctcctacgcttcatgaattatatgatttagaggtagacggaccggaggaccctaatgaggacgacgtgaatgggttttttactgattctatgttattagctgctaatgagggagtggatttagacccaccttctggaactcttgatactccaggggtgattgtggaaagcgacataaatgggaaaaatttacctgatttgggtgctgctgaattggacttgcactgctatgaagagggttttcctccgagtgatgatgaagatgtggagaatgagcagtcaattcagaccgcagcgggtgaggtagtgaaagcagccagtgatggttttaagttggactgcccgatgctgcctggacatggctgtaagtcttgtgaatttcacaggaaaaatactggagtaaaagaaatattatgctcgctttgttatatgagagcgcattgccactttatttacagtaagtgtgtttaagttaaatttaaaggaacagtagctgtttttataactcttggatgggtgatttatgttttgcttgtgattttttataggtcctgtgtctgatgctgatgaatcgccttctcctgattcaactacctcacctcctgaaattcaggcacccgtccctgcaaatgtatgcaagcccattcctgtgaagcttaagcctgggaaacgccctgctgtggataaacttgaggatttgctggagggtgtggatgaacctttggacttgtgtacccggaaaataccaaggcaatgagtgccccgcacctgtgtttatttaatgacgtcactatttatgtgagagtgccatgtaataaaattatgtcagctgctgagtgttttattgtttcttgggtgggacttgggatatataagtaggagcagacctgtgtggttagctcacagcagcttgcttccatccatggaggtttgggccatcttggaagatcttaggcagactaggcaactgctagaaaacgcctcggacggagtctctggtctttggagattctggttcggtggtgatctggctagactagtctttagaataaaacaggattacaggcaagaatttgaaaagttattggacgactgtccaggactttttgaagctcttaacttgggccaccaggctcattttaaggagaaggttttatcagttttggatttttctacccctggtagaactgctgctgctgtagctttccttacattcatatttgataaatggatcccacagacccacttcagcaagggatacgttttggatttcatagcagcagctttgtggagaacatggaaggctcgcaggatgaggacaatcttagattactggccagtacagcctctgggcgtagcagggatcctgagacacccaccgaccatgccagcggttttggaggaggagcaccaagaggacaatccgagagtcggcctggaccctccggtggaggaggcggaggagtagctgacttgtttcctgaactgcgacgggtgcttactagatctacaaccagtggacgggacaggggcattaagagggaaaggaatcctagtggaactaatcccagatctgagttggctttaagtttgatgagtcgcagacgtcctgaaactatatggtggcatgaggttcagaatgagggcagggatgaagtatcaatattgcaagagaaatattctctagaacaggtgaaaacatgttggttggagcctgaggatgattgggaggttgccattaggaattatgccaagatagctttgaggcctgataaattgtacagaattactaaacggattaatattagaaatgcatgttatatatcagggaatggggctgaggtagtgatagacactcaagacagaacagtttttagatgctgcatgatgggtatgtggccaggggtggttggcatggaggcagtaacccttatgaatgtaaagtttagaggggatgggtataatggtgtggtttttatggctaatactaaattgattttgcatggttgtagcttttttggttttaataatatatgtgtggaagcttgggggcaggtgagtgtaagaggctgtagtttctatgcatgctggattgcaacatcaggcaggaccaagagtcaattgtctgtaaagaaatgtatgtttgagagatgtaacctgggcatactgaatgaaggagaagccagagtcagccactgtgcttcttccgaaactggctgtttcatattgataaagggaaatgccaatgtgaaacataatatgatctgtggaccctcagatgagaggccttatcagatgctgacatgtgctggcggacattgcaatatgctggctaccgtgcatattgtttctcacccacgcaagaaatggcctgttttggaacataatgtgatgaccaaatgcactatgcacgtaggtggtcgcagaggaatgttaatgccataccagtgtaacatgaataatgtgaaagtgatgttggagccagatgcattttccagaatgagtttaacaggaatctttgacatgaatctgcaaatatggaagatcctgagatatgatgacacgaagtcgagggtacgcgcatgcgagtgcgggggcaaacatgccaggttccagccggtgtgtgtggatgtgactgaagaactaaggccagatcatttggtgattgcctgcactggagcggagttcggttctagtggtgaagaaactgactaaagtgagtagtagtgggatggtttggatggactctaatgtgaataagatggacagattgggtaaatttttgttttttctgtcttgcagctgtcatgagtggaagcgcttcttttgaggggggagtctttagcccttatctgacgggccgtctcccaccatgggcaggagtacgtcagaatgtcatgggatctactgtggatgggagaccagtccagcccgccaattcatcaacactgacctatgccactttgagctcttcacccttggatgcagctgcagctgctgccgcctctgctgccgccaacaccgtccttggaattggctattatggaagcatcgttgccaataccagttcctcaaataacccttcgaccctggctgaggacaagctacttgttcttttggcgcagcttgaggcgttgacccagcgcctgggtgaactgtctcagcaggtggcccagctgcgcgagcaaactgagtctgctgttgccacagcaaagtctaaataaagattaatcaataaataaaggagatacttgttgattttaaactgtaatgaatctttatttgatttttcgcgcacggtatgccctggaccaccggtctcgatcattgagaactcggtggatcttttccaggaccctgtagaggtgggattgaatgtttagatacattggcattaggccgtctcgagggtggagatagctccattgaagagcctcgtgttccggggtagtgttataaatcacccagtcataacaaggtcggagtgcatgatgttgcacaatatctttaaggagcaggctgattgcaactgggagccccttggtgtatgtgtttacaaatctgttgagctgagatggatgcattctgggtgaaattatatgcatttttgactggatcttgaggttggcaatgttgccgcccagatcccgtctcgggttcatgttatgcaggaccaccaagacggtgtatccggtgcacttaggaaatttatcatgcagcttagatggaaaagcatgaaaaaatttggagacgcctttgtgtccgcccaaattctccatgcactcatccataatgatagcaatggggccgtgggcggcggcacgggcaaacacgttccggggatctgacacatcatagttatgctcctgagacaggtcatcataagccattttaataaactttgggcgtagggtgccagattggggtataaatgttccctcgggccccggagcatagtttccctcacagatttgcatttcccaggctttcagttcagagggggggatcatgtccacctgcggggctataaaaaataccgtttctggggctggggtgattaactgtgatgatagcaaattccttagcagctgtgacttgccacacccagtggggccgtaaatgaccccgattacgggttgcagatggtagtttagggagcggcagctgccgtcctctcggagcaggggggccacttcgttcatcatttcccttacatggatattttcccgcaccaagtccgttaggaggcgctctccacctagggataaaagttcctggagggaggagaagtttttgagcggcttcagcccgtcagccatgggcattttggagagagtctgttgcaagagctcgagccgatcccaaagctcggttatgtgttctatggcatctcgatccagcaaacctcctcgtttcgcggattggggcggctcctggagtagggtatcagacgatgggcgtccagcgctgccagtgtccgatccttccatggtcgcagcgtccgagtcagggttgtttccgtcacggtgaatgggtgcgcgcctggttgtgcgcttgcgagggtgcgcctcaggctcatcctgctggtcgagaaccgctgccgatcggcgccctgcatgtcggccaggtagcagtttaccatgagttcgtagttgagcgcttcggccgcatggcctttggcgcggagcttacctttggaagttttgtgacaggagggacagtatagacacttaagggcatacagcttgggtgcgaggaagattgattcgggggagtatgcatctgcgccgcaggaggcgcagacagtttcgcattccacgagccatgtcagatctggttcatctgggtcaaaaacaagttttccgccatattttttgatgcgtttcttaccttttgtctccatgagttcgtgtcctcgctgggtgacaaagaggctgtctgtgtccccgtagaccgactttataggcctgtcctcgagcggagtgcctcggtcctcttcgtataggaatcccgaccactctgatacaaaggcgcgtgtccaggctagcacaaatgaggctacttgggaagggtagcggtcgttgtcaaccagggggtccaccttctctacagtatgtaaacacatgtccccctcctccacatccagaaatgtgattggcttgtaaaggtatgccacgtgaccgggagtcccagccgggggggtataaaagggggcgggtctctgttcgtcctcactgtcttccggatcgctgtccaggagcgccaactgttggggtaggtattccctctcgaaggcaggcataacctctgcactcaggttgtcagtttctaggaacgatgaggatttgatattgacagtgcctgctgagatgcctttcatgagactttcgtccatttggtcagaaaagacaatctttttgttgtccaacttggtagcaaaggatccatatagggcattggataggagcttggctatggagcgcatggtttgattcttttccttgtccgcgcgttccttggcggcgatgttcagctggacatattcgcgcgccaggcacttccattcagggaagatggttgtcagttcatccggcacaattctgacttgccagcccctattatgtagggttatcagatccacactggtggccacctctcctcgaagaggttcgttggtccagcagagccgacccccctttctcgaacagaaagggggtagagggtctagcatgagctcatcaggggggtctgcatccatggtgaagattcctggaagtaggtccttgtcaaaatagctgatgggggtgggatcatctaaagccatctgccattctcgagctgctagcgcgcgctcatatgggttcagtggtgtaccccagggcatgggatgggtgagcgcagaggcatacatgccacagatgtcatagacataaaggggctcttctagtatgccgatgtatgtgggataacatcgcccccctctgatgcttgctcgcacataattatagagctcatgagatggggcaaggagacccgggcccagattagtgcggttgggcttctctgccctgtagacaatttggcgaaagatggcatgggaattagaagagatagttggcctttggaatatgttaaagtgggcatggggtaaacctacagaatccctgatgaagtgggcatatgattcttgcaacttggccactagctctgcggtgaccaggacgtccatggcgcagtagtcgagggtctctttgatgatgtcataacctggttggttttttttttcccacagctcgcggttgaggaggtattcttcgcgatccttccagtactcttcgaggggaaacccgtctttgtctgcacggtaagagcccagcatgtagaattgattgactgccttgtaaggacagcaccccttctccacagggagagagtatgcttgagcggctttgcgcagtgaggtatgagtaagggcgaaggtgtccctgaccataactttgaggaactggtacttgaagtcgatgtcgtcacacgtcccctgttcccagagttggaagtccacccgcttcttgtaggcggggttgggcaaagcgaaagtaacatcgttgaagagaatcttgccggccctgggcaaaaaattgcgggtaatgcggaaaggctggggcacctctgctcgattattgatcacttgcgcagctaggacgatctcgtcaaagccgttaatgttgtgccccactatgtacatttctatgaatcgtggggagcctctgatgtgaggtagctttttgagctcttcgaaggtgaggtctgtagggtcagagagagcgtagtgttcgagggcccattcgtgcaggtgagggtttgcattcatgaaagatgaccaaagatccactgccagtgctgtttgtaactggtcccggtactggcgaaaatgctgaccgactgccatcttttctggggtgacacagtagaatgttttggggtcctgctgccaacgatcccacttgagtttcatggcgagatcgtaggcgatgttgacgagccgttcgtcccccgaaagtttcatgaccagcatgaaggggactagctgctttccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactcccttcggcgcgccgagcattcatgcttgtgcttgtacagacggccgcagtactcgcagcgctgcacgggatgcacctcatgaatgagttgtacctggtttcctttgacaagaaatttcagtgggaagttgaggcctggcgtctgtacctcgtgctctactatgttatttgcatcggcctggccatcttctgtctcgatggtggtcatgctgacgagaccccgcgggaggcaagtccagatctcggcgcgggaggggcggagctcgaggacgagagcgcgcaggccggaactgtccagggtcctgagtcgctgcggagtcaggttagtagggaggctctggagattgacttgcaagattttttcgagggcatgggggaggttaagatggtacttgatctctactggtccgttggtggagatgtcgatggcttgcagggttccatgtcccttgggcgccaccactgtgcccttgtttttcctttttggcgggagtggtggtggctctgttgcttcttgcatgttcagaatcggtggcgagggcgagcgccgggcggtaggggcggctcgggccccggtggcatggccggcagtggcacgtcggcgccgcgtgcgggtaggttctggtactgcgccctgagaagacttgcgtgcgcaacgacgcggcggttgacgtcttggatctgccgcctctgggtgaaagctaccggacccgtgagcttgaacctgaaagagagttcaacagaatcaatttcggtatcgttaacggcggcctgtctcaggatctcttgcacgtcgcctgagttgtcctggtaggcgatctcggccatgaattgctcgatttcttcctcctgaagatctccgcgacccgctctctcgacggtggccgcgaggtcgttggaaatgcgggccatgagttgagagaatgcattcatgcccgcctcgttccagacgcggctgtagaccacggccccttcgggatctcttgcgcgcatgaccacctgggcaaggttgagctccacgtggcgcgtgaagaccgcatagttgcagaggcgctggtataggtagttgagtgtggtggcgatatgctcggtgacgaagaagtacatgatccatcgtctcagcggcatttcgctgacatcgcccagggcttccaagcgctccatggcctcgtagaagtccacggcgaagttgaaaaactgagagtttcgcgcggacacggtcaactcctcctccagaagacggatgagttcggcgatggtggcgcgcacttcgcgctcgaaggcccccgggatttcttcctcctcttctaactcttcttccactaacatctcttcttcctcttcaggcgggggcggaggaggaggagggggtacgcggcgacgccggcggcgcacgggcaaacggtcgatgaatctttcaatgacctctccgcggcggcggcgcatggtctcggtgacggcacggccgttctccctgggtctcaaagtgaaaacgcctccgcgcatctccctgaagtggtgacttgggggctctccgttgggcagtgaaagggcgctgattatgcactttatcaattgtcctgtagggactccgcgcaaggacctgatcgtctcaagatccacgggatctgaaaatctttcaacgaaagcgtctaaccagtcgcaatcgcaaggtaggctgagcactgtttcttgctggcgggggtggctacacgctcggtcggggttctctctttcttctccttcctcctcttgggagggtgagacgatgctgctggtgatgaaattaaaataggcagttctgagacggcggatggtggcgaggagcaccaggtctttgggaccggcttgctggatgcgcaggcgattggccattccccaagcattatcctgacacctggccagatttttgtagtagtcttgcataagtcgctccacgggcacttcttcttcgcccgctctgccatgcatgcgcgtgagcccaaacccacgcatgggctggataagtgccaggtctgctacgaccctttctgcgaggatggcttgctgcacctgagtgagggtggcttggaagtcgtcgaagtccacaaaacgatggtaggccccggtgttgatggtgtaagagcagttggccatgactgaccagttaactgtctggtgccccgggcgcacaagctcggtgtacttgaggcgcgagtaggcgcgggtgtcaaagatgtaatcgttacaggtgcgcaccaggtactggtagccgatgagaaagtgcggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgaggcgcgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttttttttgctttttcctggattggagccagtgctgcgtcaagctttagaacgctcagttcgcggggttgggagtggctcgcgcccgtagtctggagaatcaatcgccagggttgcgttgcggtgtgccccggttcgagtcttagcgcgccggatcggccggtttccgcgacaagcgagggtttggcagccccgtcatttctaagaccccgccagccgacttctccagtttacgggagcgagccctctttttttttttttgttgcccagatgcatcccgtgctgcgacagatgcgcccccagcaacagcccccttctcagcagcagctacagcaacagccacaaaaggctcttcctgctcctgtaactactgcggctgcagccgtcagcggcgcgggacagcccgcctatgatctggacttggaagagggcgagggactggcgcgcctgggtgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggtctgatgcacctgtgggacctgatggaagctattacccagaaccccaccagcaaacctctgaccgctcagctgtttctggtggtgcaacatagtagagacaatgaggcatttagggaggcgctgttgaacattactgagcccgaggggagatggttgtatgatcttatcaatattctgcaaagtataatagtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgacgggggctggaaccgagggggagaactactttgacatgggagcggacttgcagtggcagcccagtcgcagggccctggacgcagcagggtatgagcttccttacatagaagaggtggatgcaggccaggatgaggagggcgagtacctggaagactgatggcgcgaccatccatatttttgctagatggaacagcaggcaccggaccccgcaatacgggcggcgctacagagccagccgtccggcattaactcctcggacgattggagccaggccatgcaacgcatcatggcgctgacgacccgcaaccccgaagcctttagacagcaaccccaggccaaccgcctttctgccatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgttacaacagcagcaacgtgcagaccaacctggaccggatggtgaccgatgtgcgcgaggccgtgtcccagcgcgagcggttccagcgagacgccaatttagggtcgctggtggctttgaacgccttcctcagcactcagcctgccaacgtgcctcgcggtcagcaagactacacaaactttctaagtgcattaagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactacttctcttggtagccccattcactgacagcggtagcatcgaccgtaattcttacttgggctatctgttgaacctgtatcgcgaggccatagggcaaactcaggtagatgagcaaacctatcaagaaattacccaagtgagccgcgctctgggtcaggaggacactggcagcttggaagccaccttaaacttcttgctgaccaaccggtcgcagaagatccctcctcagtatgcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacatgcccgaccccaatgacgggtttttatgggacgatgtggacagtagtgttttctccccgcctcctggttataacacttggaagaaggaaggtggcgatagaaggcactcttccgtgtcactgtccggggcaacgggtgctgccgcagcggttcccgaggctgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatcacagggacgatccccgggcgctgggggatagccggggcagcgctacccgtaaacgccagtggcacgacaggcagcggggcctggtgtgggccgatgaggattccgccgacgacagcagcgtgttggacttgggtgggagtggtggtaacccgttcgctcacctgcgcccccgcgtcgggcgcctgatgtaagaaaccgaaaataaatacttaccaaggccatggcgaccagcgtgcgttcgtttcttctctgttatatctagtatgatgaggcgaaccgtgctaggcggagcggtggtgtatccggagggtcctcctccttcgtacgagagcgtgatgcagcaggcggcggcggcggcgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaacttctcagccacaatgaccattgacctaatgaacaatgccatcattgataattaccttgaagtgggcagacagaatggagtgttggagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctatgagaacagtaagaaagaacaagaagccaaaacagaagccgctaaagctgctgctattgctaaagccaacatagttgtcagcgaccctgtaagggtggctaatgccgaagaagtcagaggagacaactatacagcttcatctgttgcaactgaagaatcgctattggctgctgtggccgaaaccgaaactacagagacaaaactcactattaaacctgtagaaaaagacagcaagagtagaagttacaatgtcttggaagataaagtcaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaaaaaaaaaatgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtacccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctacggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttagaagatactgagcagtctccgatgttgtgtcccagcgaggatgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggtggagtttgtacgcgagttcgccccaaggcggcgtgtgcagtggcgtggacgcaaagtgcggcctgtgctgagacctggaaccacggtggtctttacgcccggcgagcgcaccagcactgcttttaagcgatcctatgatgaggtgtatggggatgatgatattctggagcaggcggccgaccgcctgggcgagtttgcttatggcaagcgctcccgctccagccccaaggaggaggcggtgtccattcccttggacaatgggaatcccacccctagcctcaagccagtcaccctgcagcaagtgctgcccgtgcctccacgcagaggcaacaagcgagagggtgaggatctgtatcccacgatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtccatggaagtccaaaccgaacctgcaaagcccacaaccacctccattgaggtgcaaacggatccctggatgtccgcacccgttacagctcaagctgctgtcaacaccactcgaagatcccggcgaaagtacggtccagcaagtttgctgatgccaaattatgctctgcacccatctattattccaactccgggttaccgaggcactcgctactaccgcagccggagcagcacttcccgccgtcgccgcaaaacacctgcaagtcgtagtcaccgtcgtcgtcgccgccccgccagcaatctgacccccgctgctctggtgcggagagtgtatcgcgatggccgcgcagatcccctgacgttgccacgcgtacgctaccatccaagcatcacaacttaacgactgttgccgctgcctccttgcagatatggccctcacttgccgccttcgtgtccccattactggctaccgaggaagaaactcgcgccgtagaagagggatgttggggcgcgggatgcgacgccacaggcggcggcgcgctatcagcaaaaggctggggggtggctttctgcctgctctgatccccatcatagccgcggcgatcggggcgataccaggcatagcttccgtggcggttcaggcctcgcagcgccactgacattggaaaaacttataaataaaatagaatggactctgatgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcactgagaaataagcttaaagagcaaaacttccaacagaaggtggttgatgggatcgcctctggtatcaatggggtggtggatctggccaaccaggccgtacagaaacagataaacagccgcctggacccgccgccgtcagccccgggcgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctcctccccctactgctgcagcgcctgctcgcaagcctgtcgctaccccgaagcccaccaccgtacagcccgtcgccgtagccaggccgcgtcctgggggcactccacgtccaaatgcaaactggcagagtactctgaacagcatcgtgggtctgggcgtgcaaagtgtaaagcgccgtcgctgcttttaaattaaatatggagtagcgcttaacttgcctgtctgtgtgtatgtgtcatcatcacgccgccgcagcaacagcagaggagaaaaggaagaggtcgcgcgccgaggctgagttgctttcaagatggccaccccatcgatgctgccccagtgggcatacatgcacatcgccggacaggatgcttcggagtacctgagtccgggtctggtgcagttcgcccgcgccacagacacctacttcaatctggggaacaagtttaggaaccccaccgtggcgcccacccatgatgtgaccaccgaccgcagtcagcggctgatgctccgctttgtgcccgttgaccgggaggacaatacctactcatacaaagttcgatacaccttggctgtgggcgacaacagagtgctggatatggccagcactttctttgacattcggggtgtgttggatagaggccctagcttcaagccatattctggcactgcttacaactcattggcccctaagggcgctcccaatacatctcagtggattgctgaaggcgtaaaaaaagaaaatggggaagctgacgatgaagcagctgtcgaagaggaagaggaagagaaaaatcttaccacttacacttttggaaatgccccagtgaaagcagaaggtggtgatatcactaaagacaaaggtcttccaattggttcagaaattacagacggcgaagccaaaccaatttatgcagataaactataccaaccagaacctcaggtgggagaggaaacttggactgacacagatggaacaactgagaagtatggtggtagagctctaaagccagaaactaaaatgaaaccctgctatgggtcttttgctaaacccactaacgtcaaaggcggacaggcaaaacaaaaaactactgaacaactgcaaaaccagcaggttgaatatgatattgacatgaacttttttgatcaagcgtcacagaaagcaaacttcagtccaaaaattgtgatgtatgcagaaaatgtagacttggaaaccccagacactcacgtggtgtacaaacctggtacttcagaagaaagttctcatgctaatctcggtcaacaatctatgcccaacagacccaactacattggctttagagataactttattggacttatgtactacaacagtactggcaacatgggagtgctggcaggtcaagcatcccaattgaatgcggtggttgacttgcaggacagaaacacagaactatcatatcaactactgcttgattctctgggtgacagaaccagatacttcagcatgtggaatcaagcagtcgatagctatgatcctgatgtgcgcattattgaaaatcatggggtggaagatgagcttcccaactactgctttccattggatggagtaggggtaccaacaactagttacaaaataattgaaccaaatggagagggtgcagattggaaagagcctgacataaatggaacaagtgaaattggacaaggaaatctctttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctagtggatacctacgtaaacattggcgccagatggtctttggatgccatggacaatgtcaaccccttcaaccatcaccgcaacgctggcctgcgataccggtccatgcttttgggcaatggtcgctacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcatcagttttaccagcatcaatctctatgccaccttcttccccatggcccacaacactgcctccacccttgaagccatgctgcgcaatgacaccaatgatcaatcattcaatgactacctttctgcagccaacatgctctaccccatcccggccaacgctaccaacgttcccatctccattccctctcgcaactgggccgccttcagaggctggtccttcaccagactcaaaaccaaagagactccctctttgggatcagggttcgatccctactttgtttactctggttctataccttacctggatggtaccttctaccttaaccacacttttaagaaagtctctatcatgtttgactcttcagtcagctggcctggtaatgacagattgctaactccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcagcccatgcgctggacatgacttttgaggtggatcccatggatgagcccaccctgctttatcttctttttgaagtattcgacgtggtcagagtgcaccaaccacaccgcggcgtcatcgaggccgtctacctgcgcacaccgttctcggctggtaacgccaccacataagaaacctgcttcttgcaaggtgcagccatggcctgcgggtccggaaacggctccagcgagcaagagctcagagccatcgtccgagaccttggctgtggaccctacttcctgggaacctttgacaaacgcttcccggggtttatggctccaaacaagctggcctgcgccattgtcaacacagccggtcgcgagacggggggagagcactggttggcttttggttggaacccgcgctccaacacatgctacctttttgatccgtttggattctcggatgaccgtctcaagcagatctaccagtttgaatacgaggggttactgcgccgcagcgcccttgctactaaggatcgctgcattaccttggaaaagtccacccaaaccgtgcagggtccgcgctccgccgcttgtggacttttttgctgcatgtttctccatgcctttgtacactggccagaccgccccatggacggtaaccccaccatgaagttgcttacgggagtgcccaacagcatgctccagtcaccccaagtccagcccaccctgcgcaggaaccaggaggcgctctaccatttcctcaacacacattcatcttactttcgttctcaccgcgcacgtatcgaaagggctactgcgttcgatcgtatgggatattaataagtcatgtaaaaccgtgttcaataaacagaactttattttttacatgcactggtggtttctcattcatttattcactcagaagtcgaaggggttttggcgggaatcagagtgacccgcgggcagggatacgttgcggaactggaactgagcctgccacttgaattcggggatcaccagcttgggaactggcaggtcaggcaggatgtcgctccacagcttcctggtcagttgcagggctcccaacaggtcaggagctgaaatcttgaaatcgcaattgggacccgtgctctgagcgcgggagttgcgatacacagggttgcaacactggaacaccatcagcgacgggtatttcacactcgccaacacagtgggatcggtgataattcccacatccaggtcttcggcattggccatgctaaagggggtcatcttgcatgtctgtctgcccatagccggtacccagcctggcttgtggttgcaatcgcagcgcagagggatcagcatcatcttggcctggtcggatctcataccgggatacacagctttcatgaaagcttcatattgcttgaaagcctgttgggccttgctaccctcagtgtagaacatcccacatgacttgctagagaactggttagcagcacatccggcatcattcacacaacagcgagcgtcgttgttggctatttgcaccacactcctgccccagcggttctgggtgatcttggttcgctcagggttctccttcagcgcccgttgaccgttttcgcttgccacatccatttctatgatatgttccttctgaatcatgatgttgccatgcaaacacttcagcttgccttcataatcattacatccatgtgaccacagcgcgcatcccgtacactcccagttattgtgagcgatctcagaataggaatgcaccaacccctgcaggaatcttcccatcatggttgagagggtcttgttactggtgaaagtcagcgggacgcctcgatgctcctcgttcacatactggtggcaaattcgcttgtactgttcatgctgctctggcataagcttgaaagaggttcttaggtcattctccagcctgtacttctccatcagcacagccattacttccatgcccttttcccaggcagaaaccaggggtaggctcatggaatttctaacagaaatagcagctactttagccagagggtcatccttgtcaatcttctcaacacttcttttgccatccttctcagtgatgcgcacgggtgggtagctgaagcccacggccaccagctccgcctcttctctttcttcttcgctgtcctgactgatgtcttgtaaagggacatgcttggtcttcctgggcttctttttggggggtattggcggagggctgctgctccgctccggagacatggaggaccgcgaagtttcgctcaccagtaccacctggctctcggtagaagaaccggaccccacacggcggtaggtgttcctcttcgggggcagaggtggaggtgactgcgatgggctgcggtccggcctgggaggcggatgactggcagagccccttccgcgttcgggggtgtgctcccggtggcggtcgcttgactgatttcctccgcggctggccattgtgttctcctaggtagagaaacaacagacatggagactcagccatcgctgccaacaccgctgcaagcaccatcacacctcgcctccagcgatgaggaggaggaacaaagcttaaccgccccaccacccagtcccgccaccaccacctctaccctcgaggatgaggaggtcgacgcaccccaggagatacggacgcaggatatggaggatgagaaagcggaagagattgaggcagatatcgagcaggacccaggctatgtgacaccggccgagcacgaggaagagctgagacgctttctagagaaagatgatgacaaccgtccagaacagcaagcagatggcgatcagcagaatgttgggctcggggatcatgttgtcgactacctcaccggccttggtggggaggacgtgctcctcaaacacctagcaaggcagtcgatcataatcaaagatgcactgcttgatcgcagcgaagtgcccatcagtgtggaagagctcagccgcgcctacgagctcaacctgttctcgcctcgggtaccccccaagcgtcagccaaacggcacctgcgagcccaaccctcgcctcaacttctatcccgcattcaccgtccccgaggtgctggctacctaccacatatttttcaaaaaccaaaaaattccaatttcctgccgcgccaaccgaactcgcgccgatgccctgctcaacttgggacctggcgcttgcttacctgatataacttccttggaagaggtcccaaagatcttcgaaggtctgggcagtgatgagactcgggccgcaaatgctctgcaacagggagagaatggcatcgatgaacatcacagcgctctggtggagttggagggcgataatgcccgactagcagtactcaagcgcagtatcgaggtgacccatttcgcataccccgctgtcaacctgcctcccaaagtcatgagcgctgtcatggatcagatactcattaaacgcgcaagtcccctttcagaaaacatgcaggatccagacgcctcggatgagggcaagccagtggtcagtgatgaacagctatctcgctggctgggcaccaactccccacgagacttggaagagcggcgcaagctcatgatggccgtggtgctagttactgtggaaatggagtgtcttcgccgcttcttcactgaccccgagacactgcgcaagctcgaggagaacctacactacacttttagacatggatttgtgagacaggcatgcaagatctccaacgtggagcttaccaacctggtttcctacatgggcattttgcatgaaaacagactcggacagagcgtgctgcacaccaccctgaagggggaagcccgtcgcgactacatccgcgacactgtctacctctacctctgccatacctggcagactggtatgggtgtgtggcagcagtgtttggaagaacaaaacctgaaagaactagacaagctcttacagagatccctcaaaaccttgtggacgggttttgacgagcgcacagtcgcctctgatctggcagatctcatcttcccagagcgtctcaggactactctgcgcaacgggctgcctgacttcatgaaccagagcatgattaacaactttcgctctttcatcctggaacgctccggtatcctgcccgccacctgctgtgcgctaccatccgactttgtgcctctgacctaccgcgagtgccccccaccgctatggagccactgctacctgttccgcctggccaactacctatcataccactcggatgtgatcgaggatgtgagcggagatggcctgcttgagtgccactgccgctgtaatctctgctcaccacatcgctccctagtctgtaacccccagttgcttagcgaaacccaaattataggcaccttcgaattgcagggtcccagcagcgaaggcgaggggtcttctcctgggcaaagtttgaaactgaccccgggactgtggacctccgcctacctgcgcaagttctcccccgaggactaccacccctatgagatcaggttctatgaagaccaatcacagccgcccaaagctgagctctcagcgtgcgtcatcacccagggggcaattttggcccaattgcaagccatccaaaaatcccgccaagaatttttgctgaaaaagggtaacggagtctacctcgacccccagactggtgaggagctcaacacaaggttctctcaggatgtctcagcgccgaggaaacaagaagttgaaagtgcagctgccgcccccagaggatatggaggaagactgggacagtcagacagaggagatggaagattgggacagccaggcagaggaggaggaggacagcctggaggaagacagtttggaggaggaagacgaggaggcagaggaggtggaagaagcaaccgccgccaaacagttgtcctcggcggcggaaacaagcaaggccacagacaacaccacagctaccatctccgttccgggtcggggggtccagcaccgtcccaacagtagatgggatgagaccgggcgactcccgaatgcgaccaccgcttctaagactggtaagaaggagcggcagggatacaagtcctggcgggggcataagaacgctatcatatcctgcttgcatgaatgcgggggcaacatatccttcacccgccgctacctgctcttccaccacggggtgaacttcccccgcaatgtcttgcattactaccgtcacctccacagcccctactacagccagcaagcctcggcagaaaaagacaacagcagcaagaacctccagcagaaaaccagcagcagttagaacacccacagcaggtgcaacaggaggaggactgagaatcacagcgaacgagccagcgcagacccgagagctgagaaaccggatttttccaaccctctatgccatcttccaacagagtcgggggcaagagcaggaactgaaagtaaaaaaccgatctttgcgctcgctcacccgaagttgtttgtatcacaagagcgaagaccaacttcagcgcactctcgaggacgccgaggctctcttcaacaagtactgcgcgctcactcttaaagagtagcccgcgcccgcgctagctcgaaaaaaggcgggaattacgtcacccattggcgcctgtcctttgccctcgtcatgagtaaagaaattcccacgccttacatgtggagttatcaaccccaaatgggactggcagcaggcgcctcccaggactactccacccgtatgaattggctcagcgccggtccctcgatgatctcacgggttaatgatatacgagcttatcgaaaccaattactcctagaacagtcagcacttaccgccacacccagacaacacctcaatccccggaattggcccgccgccctggtgtaccaggaaacccccgctcccaccaccgtcctacttcctcgagacgcccaggccgaagttcagatgactaacgcaggtgtacagctggctggcggttccgccctgtgtcgtcaccggcctcaacagagtataaaacgcctggtgatcagaggccgaggtatccagctcaacgacgagtcggtgagctcttcgcttggtctacgaccagacggagtcttccaaattgccggctgcgggagatcttccttcactcctcgtcaggctgtactgactttggagagttcgtcatcgcagccccgctcgggtggcatcgggactctccaatttgtggaggagtttactccctctgtctacttcaaccccttctccggctctcctgggcattacccggacgagttcataccaaacttcgacgcaatcagcgagtcagtggatggctatgattgatgtctaatggtggcgcggctgagctagctcgactgcgacatctagaccactgccgccgctttcgctgctttgcccgagaactcaccgagttcatctacttcgaaatacccgaggagcaccctcaaggaccggcccacggagtgcgtattaccatcgaaggggggatagactctcgcctgcatcggatcttctgccagcgacccgtgctaatcgagcgcgaccagggaaacaccacagtctccatctactgcatctgtaaccaccccggattgcatgaaagcctttgctgtcttatttgtgctgagtttaataaaaactgagttaagactctcctacggactaccaattcttcaactcggactttataacaatcagaccctccgttcaagtcagaagaccccaacccttcctctgatccaggaatctaattctacctccccagcaccacactttactagccttcccgaaactaacaacctcggagctcaactgcaccacttttccagaagccttctctctgccaatactaccactcccagaaccggaggtgagctccgtggtcttcctaataacaacccctgggtggtaactgggtttgtaacgctaggtgtagttgcgggtgggcttgtgcttgtcctttgctacctatacacaccttgctgtgcttatttagtaatcttgtgttgctggtttaagaaatgggggccctactagtcgcgcttgctttactttcacttttggatctgggctctactatgctagttcagcctgtactatttgatccatgcctcaattttgatccagacaactgcacactcacttttgctccagaggctggccgctgtggagttcttattaggtgcggacgggaatgcagtcccattgaaatacaccacaataacaaaatttggaacaataccttattcaccacatggcagccaggagaccctgagtggtatactgtctctgtccgtggtcctgacggttccatccgcactgctaataacacttttatttttgctgagatgtgcgatctgaccatgttcatgagcaaacagtataacctatggcctccaagcaaggagaacattgtggcattctccattgcttattgcttgtgtacgtgtctcattactgctattctatgtatctgcatacacttgcttatttgccaccgccacagaaacagcaatgaggaaaaagagaaaatgccttgagctttttctcatttttgttttttttgtttacagccatggcttcagttatagctctaattattgtcagcattctcactgccgcacagggacaaacaattgtctatattaccttaggtcataaccgcactcttataggaccccaaattagttcacaggttatatggaccaaacttggaagtgttgattattttgacataatctgcaacagaactaaaccaatatttgtaacctgtaacaaacaaaatctcaccttaattaatgttagcgaaatttacagcggttactattatggttatgacagacacagcagtgaatataaaaattacctagttcgcataactcaacccaaaaccacaaaaatgccaaataaggcaaaaattcaaatggttagcgcattagaacatcttacatatcccaccacacccgatgagagaaacattccaaattcaatgattgccattattgcggcggtggcagtgggaatggcactaataataatttgtatgttcctatatgcttgttactgtagaaagtttcatcacaaacaggattccctactaaatttttgacatttaattttttatacagctatggtttccactacagccttttttgttattagtagccttgcagctgtcacttatggtcgctcacacctcactgtaactgttggctcaacttgtacactacaaggaccccaagaagggcatgtcagttggtggagaatatatgatagtggatggttcattaggccatgtgaccagcctggtaacaaatttttctgcaacgggagagacttgaccattattaacatcacagtaaatgaccagggcttctattatggaactaactataaaaataacttagattacaacattatcgtagtgccagccaccactccagctccccgcaaaaccactttctttagcagcagtgccagtatttctaaaacagcttctgcaagcttcaaaaaattcgctttacgtaattccacaacctcttccacttccaataatacaatgtctaaatcagtaatcggcatcgctgctgccgcgatagtgggattaatgattataattctatgcataatctactacgcctgctgctatagaaaacaacatgaacaaaaaaccgatcccttgctgaattttgatatttaatttttttatagaatcatgaaaaaactaagtatcctagctttcattttgtttcaaacatttaccaatgtgcagactactttaagtcatggtatagagaaccacactacctcttatgagctcacaaacattactacccatcatcctaaatatgctatgcaactagaaatcaccatgctaattgtagttggaatacttatcctagctattattttctattttacactatgccgccaaatacctaatattcataaaaattctaaaagacgtcccatctattgccctgtgattagtcgaccccatatgactctaaatgaaatctaagatcatctatttctcttttttacagtatggtgaacaccaatcatgattcctagaaatttcttcttcaccatactcatctgtgcttttaatgtctgtgccaccttcacagcagtagccactgcaaccccagactgtataggagcatttgcctcatatacacttttcgcttttgtcgcttgcacctgcgtgtgtagcgtagtctgcctggttattaattttttccaacttgtagactggatctttgtacgacttgcctacctgcgtcaccatcccgaataccgcaatcaacatgttgcggcacttctcagacttatttaaaaccatgcaggctatactaccagtcattctgcttctgttgctcccctgcgatgccttaacccccgtcgctaatcgtaccccacctgaacaacttagaaaatgcaaattccaacaaccatggacattccttgattgctaccgagaaaaatctgatttccctacatactggattatgatcattggaattgtcaatctagtttcttgcacactattctctttccttgtttatcatttttttgattttggatggaatgcccccaatgcactcacttacccacaagaaccagaggaacatatcccactacagaacatgcaacagccaatagctataatagattatgacaatgagccacagccctcgctgcttcctgctattagttacttcaacctaaccggtggagatgactgacccactcgccgcctccactgctgccgaggaactacttgatatggacggccgcgcctcagaacagcgactcgcccaactacgcatacgccagcagcaggaacgtgccgccaaggagctcagggatgctattgaaattcaccagtgcaaaaaaggcatattctgtctggtgaaacaagccaagatttcctacgagattaccaatactgaccatcgcctctcatacgagctcggaccgcagcggcaaaaattcacttgtatggtgggaatcaaccccataatcatcacccagcaagctggagatatcaagggttgcatccactgttcctgcagttccaccgagtgcatctacaccctgctgaagaccctctgcggccttcgagacctcctacccatgaactaatcaacccagcccctcacttaccaattacataaagccaattaataaaaatcacttacttgaaatcagaaataaggtttctgtctacgttgtttccaagcagcacctcacttccctcttcccaactctggtactctaagcctcggcgggtggcatacttcctccacactttgaaagggatgtcaaattttagttcctcttctttgcccacaatcttcatttctttatccccagatggccaaacgagctcggctaagcagctccttcaatccggtctacccctatgaagatgaaagcagctcacaacacccctttataaaccctggtttcatttcctcaaatggttttacacaaagcccagatggagttctaactcttaaatgtgttaatccgctcactaccgccagcggacccctccaacttaaagttggaagcagtcttacagtagatactatcgatgggtctttggaggaaaatataactgccgcagcgccactcactaaaactaaccactccataggtttatcaataggatctggcttgcaaacaaaggatgataaactttgtttatcgctgggagatgggttggtaacaaaggatgataaactatgtttatcgctgggagatgggttaataacaaaagatgatacactatgtgccaaactaggacatggccttgtgtttgactcttccaatgctatcaccatagaaaacaacaccttgtggacaggtgcaaaaccaagcgccaactgtgtaattaaagagggagaagattccccagactgtaagctcactttagttctagtgaagaatggaggactgataaatggatacataacattaatgggagactcagaatatactaacaccttgtttaaaaacaaacaagttacaatcgatgtaaacctcgcatttgataataccggccaaattatcacttacctatcatctcttaaaagtaacctgaacttcaaagacaaccaaaacatggctactggaaccataaccagtgccaaaggcttcatgccaagcaccactgcctatccatttataacatacgccactcagtccctaaatgaagattacatttatggagagtgttactacaaatctaccaatggaactctctttccactaaaagttactgtcacactaaacagacgtatgtcagcttctggaatggcctatgctatgaatttttcatggtctctaaatgcagaggaagccccggaaactaccgaagtcactctcattacctcccccttctttttttcttatatcagagaagatgactgacaacaaaaaaaaaaataaagatcaacttttttattgaaaatcagtttacaagattcgagtagttattttgcccccctcttcccattttatagaatacacaattctctccccacgcacagctttgaacatttgaattccattagagata

SEQ ID NO: 1429 - DNA, 32767 bp, Human mastadenovirus D
ataatataccccacaaagtaaacaaaagttaatatgcaaatgagcttttgaattttaacggttttggggcggagccaacgctgattggtcgagagaagacgatgcaaatgacgtcacgacgcacggctgacggtcgccgcggaggcgtggcctagcccggaagcaagtcgcggggctgatgacgtataaaaaagcggactttagacccggaaacggccgattttcccgcggtcacgccaggatatgaggtaattctgggcggatgcaagtgaaattaggtcattttggcgcgaaaactgaatgaggaagtgaaaagcgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaagaggctgtgaatttaatatttccagaatctatgattctccaggctgacatagctagcgaagctatagttactccacttcataccccaactctgccgcccatacctgaattggaagaggaggatgagatagacctccggtgctacgaggaaggttttcctcccagcgattcagaggacgaacagggtgagcgagagatggctattctatcggactttgcttgtgtgattgtggaggagcaagatgtgattgaaaaatctactgagccagtacaaggctgtaggaactgccagtaccaccgggataagtccggagatgtgaacgcctcctgcgctctgtgctatatgaaacagactttcagctttatttacagtaagtggagtgaatgtgagagaggctgagtgcttaacacataactgtaatgcttgaacagctgtgctaagtgtggtttatttttgttactaggtccggtgtcagaggatgagtcatcaccctcagaagaagaccacccgtccccccctgagctgtcaggcgaaacgcccctgcaagtgcacagacccaccccagtcagaccaagtggcgagaggcgagcagctgttgaaaaaattgaggacttgttacatgatatgggtggggatgaacctttggacctgagcttgaaacgccccaggaactaggcgcatatgcgcttagtcatgtgtaaataaagttgtacaaataaaaagtatatgtgacgcatgcaaggtgtggtttatgactcatgggcggggcttagtcctatataagtggtaacacctgggcactcaggcacagaccttcagggagctcctgatggaggtgtggactatccttgcggactttaacaagacacgccggcttgtggaggatagttcagacgggtgctccggtttctggagacactggtttggaactcctctagctcgcctggtgtacacagttaagaaggattatcaggaggaatttgaaaatctttttgccgactgttctggccttcttgattcactgaatctcggccaccaggctctattccaggaaagggtcctccacagccttgatttttccagcccagggcgcactacagccggtgttgcttttgtggtgtttctggttgacaaatggagccagcaaacccacctaaccagggattacatcctggacttcacggccatgcatctgtggaaggcctgggtcaggcagcggggacagagaatcttgaactactggcttctacagccagcagctccgggtcttcttcgtctacacagacaaacatccatgttggaggaagagatgagggaggccatggacgagaacccgaggagcggcctggaccctccgtcggaagaggagctggattgaatcaggtatccagcctgtacccagagcttagcaaggtgctgacaaccatggccaggggagtgaagagggagaggagcgatgggggcaatactgggatgatgaccgagctgacagccagcctgatgaatcgcaggcgacctgagcgcattacctggcatgagctacagcaggagtgcagggatgagataggcctgatgcaggataaatatggcctggagcagataaaaacccactggttgaacccagatgaggattgggaggaggccattaagaaatatgccaagatagccctgcgcccagattgcaagtacagggtgaccaagacggtgaatatcagacatgcctgctacatctcagggaacggggcagaggtgatcatcgataccctggataaggctgccttcaggtgttgcatgatgggaatgagagccggtgtgatgaatatgaattcaatgatattcatgaacatcaagttcaatggagagaagtttaatggggtgctgttcatggccaacagccacatgaccctgcacggctgtaatttctttggctttaacaacatgtgtgcagaagtctggggtgcttccaagatcaggggctgtaagttttatggctgctggatgggagtggtcggaagacccaagagcgagatgtctgtgaagcagtgtgtgtttgagaagtgctacctggccgtgtctaccgagggcaatgctagagtgagacattgctcttccatggagacgggctgcttctgcctggtgaagggcacagcttctatcaagcataatgtgatcaaggggtgtactgatgagcgcatgtacaacatgctgacctgcgactctggggtctgccatatcctgaagaacatccatgtgacctcccaccctaggaagaggtggccatcatttgaaaataatgtcctgatcaagtgccatgtgcacctgggagccagaaggggtaccttccagccgtaccagtgcaactttagccagaccaagctgctgctggagaatgatgccttctccagggtgaacctgaacggtatctttgacatggatgtctcggtgtacaagatcctgagatacgatgagaccaggtccagggtgcgcgcttgcgagtgcgggggcagacacaccaggatgcagcctgtggctctggatgtaaccgaggagctgaggcccgaccacctggtgatggcctgtaccgggaccgagttcagctccagcggggaggacacagattagaggtaggttgagtattagtgggcgtggctaaggtgactataaaggtgggtgtcttacgagggtctttttgcttttctgcagacatcatgaacgggaccggcggggccttcgaaggggggcttttcagcccttatttgacaacccgcctgccgggatgggccggagttcgtcagaatgtgatgggatctacggtggatgggcgcccagtgcttccagcaaattcctcgaccatgacctacgcgaccgtggggacgagctcgtcgcttgacagcaccgccgcagccgcggcagccgcagccgccatgacagcgacgagattggcctcgagctacatgcccagcagcggtagcagcccctctgtgcccagttccatcatcgccgaggagaaactgctggccctgctggccgagctggaagccctgagccgccagctggccgccctgacccagcaggtgtccgatctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtgcagtttggcctggatcttgaggttggcgatgttgccgcccagatcccgcctggggttcatgttgtgcaggaccaccaggacggtgtagcccgtgcacttggggaacttatcatgcaacttggaagggaatgcgtggaagaatttggagacgcccttgtgaccgcccaggttttccatgcactcatccatgatgatggcaatgggcccgtgggctgcggctttggcaaagacgtttctggggtcagagacatcataattatgctcctgggtgagatcatcataagacattttaatgaatttggggcggagggtgccagattgggggacgatagttccctcgggccccggggcgaagttcccctcgcagatctgcatctcccaggctttcatctcggagggggggatcatgtccacctgcggggcgatgaaaaaaacggtttccggggcgggggtgattagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccaaggaggcggtccccgcccagcgagagcagctcttgcagggaagcaaagtttttcaggggcttgagcccgtcggccatgggcatcttggcgagggtctgcgagaggagctccaggcggtcccagagctcggtgacgtgttctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcacggagcttgcccttggaagagcgcccgcaggcgggacagaggagggattgcagggcgtatagcttgggtgcgagaaagacggactcgggggcgaaagcatccgctccgcagtgggcgcagacggtctcgcattcgactagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttagcctgccctgccgcgatgcttttgagtagactttcatccatctggtcagaaaatactatttttttattgtcaagcttggtggcgaaggagccatagagggcgttggagagaagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatctatttttgaggatgcatcatccaaggccatctgccactcgcgggcggccagcgctcgctcgtaggggttgaggggcggaccccagggcatgggatgcgtgagggcggaggcatacatgccgcagatgtcatagacatagatgggctccgagaggatgccgatgtaggtgggataacagcgccccccgcggatgctggcgcgcacgtattcatacaactcgtgcgaaggggccaagaaagcggggccgagattggtgcgctggggctgctcggcgcggaagacgatctggcgaaagatggcgtgcgagtttgaggagatggtgggccgttggaagatgttaaagtgggcgtgcggcagtcggaccgagtctcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgtgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggactgaggctcggttgttgatgacctgggcggcgaggacgatctcatcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaaggaagcccagagctcgcgggccatgagggtctggagctcgtcgcgaaaaaggcggaactgctggcccacggccatcttttctggggtgacgcagtagaaggtgagggggtcccgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccgccgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcggcagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccactggggagttggtggccgtgtccacgcattgcatgagcccgtagctgcgcggggtcacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctgaatctgtcgcctctgcgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctccacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaagtccacggcgaagttgaaaaactgggcgttgcgggccgagaccgtgagctcgtcttccaggagccggataagctcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggctgcacgacctcggagtacctgagtcgcgagaaggcgcgcgagtcgaagacgtagtcgttgcaggtgcgcacaaggtactggtagccgactaggaagtgcggcggcggctggcggtagagcggccagcgctgggtggccggcgcgcccggggccaggtcctcgagcatgaggcggtggtagccgtataggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgcggggtgtcgctagacttgaaagcggccgaaaaccccgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgttctgcgccaaatgcgtcccacccccccggcgaccaccgcgaccgcggccgtagcaggcgccggcgctagccagccaccacagacagagatggacttggaagagggcgaagggctggcgagactgggggcgccgtccccggagcgacatccccgagtgcagctgcagaaggacgtgcgcccggcgtacgtgcctgcgcagaacctgttcagggaccgcagcggggaggagcccgaggagatgcgcgactgccggtttcgggctggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcttgagcctggccgagaaggtggcggccatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacaaccgcaggccaacagactctcggccattctggaggcggtggtcccctctcggaccaaccccacgcacgagaaggtgctggcgatcgtgaacgcgctggcggagaacaaggccatccgtcccgacgaggccgggctggtatacaacgccctgctggaacgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggctaacgtgccgcgcgggcaggacgattacaccaactttatcagcgcgctgcggctgatggtgaccgaggtgccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcgtctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctgggccagaacgacaccgacagtctgagggccaccctgaacttcttgctgaccaatagacagcagaagatcccggcgcagtacgcactgtcggccgaggaggaaaggatcttgagatatgtgcagcagagcgtagggctgttcctgatgcaggagggcgccacccccagcgccgcgctggacatgaccgcgcgcaacatggaacctagcatgtacgctgccaaccggccgttcatcaataagctgatggactacctgcaccgcgcggcggccatgaacacggactactttaccaatgccatcctgaacccgcactggcttccgccgcctgggttctacacgggcgagtacgacatgcccgaccccaacgacgggttcctgtgggacgacgtggacagcgcggtgttctcgcccgcctttcaaaagagacaggaagcggtgcgcacgcctagcgagggcgctgtgggacggagcccctttcctagcttggggagtttgcatagcctgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcacccgcgccgcggcgacagcgccacgaccggcagcggggcctggtgtgggacgacgaggactcggccgacgatagcagcgtgttggacttgggcgggagcggtggtggggccaacccgttcgcgcatctgcagcccagactggggcggcggatgttttgaaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaagcatcccaaagatgtgccagttaatgatttaagcaaagatatcttagagtacgattggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcagaaatttcagactgggctgggacccggagaccaagctggtgatgccaggggtctacacctacgaggccttccacccggacgtggtgctgctgccgggctgcggggtggatttcaccgagagtcgcctgagcaacctcctgggcattcgcaagaagcaacctttccaagagggcttcagaatcatgtatgaggatctagaagggggcaacattcccgcactccttgatgtggccaagtaccttgaaagcaagaaggaactggaggatgccgccaaggaagctgcaaagcaacagggagatggcgctgtcattagaggcgatacccacctcactgtagctcaagaaaaagcagctggaaaggagctagtgattgttcccattgagaaagatgaaagcaacagaagctacaacctgatcaaggatacccatgacaccctgtaccgaagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctccacccagcaagtcagcaactacccagtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgttcgcggccacttccgcgctccctggggcgcttacaagcgcgggcggacttccaccgccgccgccgtgcgcaccaccgtcgacgatgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgaccaggcccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaacccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcgacccggcacggcggtggtgttcacgcccggcgagcggtcctctgtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacgccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgcctccacttctaccgccgccacggctaccgagcctcccaggaggcgaagatggggtgccaccagccggctgatgcccaactacgtgttgcatccttccatcatcccgacgccgggctaccgcggcacccggtattacgccagccgcaggcgcccagccagcaaacgccgccgccgcaccaccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcgggttcctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttgagggaaaagctcaaagacaagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcggccgcggcccgacgcggaggagacgatcctgcaggtggacgagccgccctcgtacgaggaggccgtgaaggccggcatgcccaccacgcgcatcatcgcgccgctggccacgggtgtaatgaagcccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagcctggcccccaagggcgccccaaatccaagtcaatgggaaacaaaagaaaagcaaggaactaccggagtccaaacggaaaaagatgtcacaaaaacatttggtgtggccgccactggcggaattaatattacaaaccagggtctgttacttggaactgatgaaaaagccgaaaatggcaaaaaagacatttatgcagacaagacttttcaaccagaacctcaagttggagaggaaaactggcaggaaaatgaagcattctacggaggcagagctcttaagaaggacaccaaaatgaaaccatgctatggatcttttgctagacctactaatgagaaaggaggtcaggcaaagttcaaaccagttaatgaaggagaacagcctaaagaactggatatagattttgcttactttgacactccaggtggcaatataacacaaggaacagaagaattaaaggcagatatcattttgtacactgaaaatgttaatctggaaacaccagacactcatgtggtatacaagccaggaacttcagatgacagttcagaaatcaatcttgttcagcagtccatgccaaacagacccaattacattggtttcagagacaactttgtggggcttatgtattacaacagcactggcaacatgggtgtgctggctggtcaggcctctcagttgaatgctgtggttgacttgcaagacagaaacaccgagctgtcataccagctcttgctagattctttgggtgacagaaccagatactttagcatgtggaactctgcggttgacagctatgatcccgatgtcaggatcattgagaatcatggtgtggaagatgaacttccaaactattgcttccccttggatggcactggaaccaattccacttaccaaggtgtaaagatcacaaatggtaatgatggcgctgaagaaagtgagtgggaaaaagacgatgctatatctagacaaaaccaaatctgcaaaggcaacgtgtacgccatggagatcaacctccaggccaacctgtggaagagttttctgtactcgaacgtggccctgtacctgcccgactcctacaagtacacgccggccaacgtcacgctgcccgccaacaccaacacctacgactacatgaacggccgtgtggtagccccctcgctggtggacgcctacgtcaacatcggcgcccgctggtcgctggaccccatggacaatgtcaacccctttaaccaccaccgcaacgcgggcctgcgctaccgttccatgctgttgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccacctttttccccatggcgcacaacaccgcctccaccttggaagccatgctgcgcaacgacaccaacgaccagtccttcaacgactacctctcggccgccaacatgctctaccccatcccggccaaggccaccaacgtgcccatctccattccctcgcgcaactgggccgccttccgcggctggagtttcacccggctcaagaccaaggaaactccctccctcggctcgggtttcgacccctactttgtctactcgggatccatcccctacctcgacgggaccttctacctcaaccacaccttcaagaaggtttccatcatgttcgactcctcggtcagctggcctggcaacgaccggctgctgacgccgaacgagttcgagattaagcgcagtgtcgacggggagggctacaacgtggctcaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcgcccaccatgcgccaggggcagccctaccccgccaacttcccctacccgctcatcggctccaccgcagtgccctccgtcacccagaaaaagttcctctgcgacagggtcatgtggcgcatccccttctccagcaacttcatgtccatgggcgcccttaccgacttgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacacccttctccgccggcaacgccaccacctaagcatgagcggttccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcatcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggaggagctctaccgcttcctcgcgcgccactccccttactttcgatcccaccgcgccgccatcgaacacgccaccgcttttgataaaatgaaacaactgcgtgtatctcaataaacagcacttttattttacatacactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccgggccggagatcttgaaatcgcagttggggccggtgctctgcgcgcgcgagttgcggtacacagggttgcagcactggaacaccatcagactggggtacttcacactggcaagcacgctcttgtcgctgatctgttccttgtccaggtcctcggcgttgctcaggccgaacggggtcatcttgcacagctggcggcccaggaagggcacgctctgaggcttgtgattacactcgcagtgaacgggcatcagcatcattcccgcgccgcgctgcatattcgggtagagggccttgacaaaggccgtgatctgcttgaaagcttgctgggccttggccccctcgctgaaaaacagcccgcagctcttcccgctgaactggttattcccgcacccggcatcatgcacgcagcagcgcgcgtcatggctggtcagttgcaccacgctccgtccccagcggttctgggtcaccttggccttgctgggctgctccttcagcgcgcgctgcccgttctcactggtcacatccatctccaccacgtggtccttgtggatcatcaccgtcccatgcagacacttgagctggccttccacctcggtgcagccgtgatcccacagggcgcatccggtgcactcccaattcttgtgtgcgatcccgctgtggctgaagatgtaaccttgcaacatgcggcccatgatggtgctaaagctcttctgggtggtgaaggtcagttgcagaccgtgggcctcctcgttcatccaggtctggcacatcttttggaagatctcggtctgctcgggcatgagcttgtaggcatcgcgcaggccgctgtcgacgcggtagcgttccatcagcacgttcatggtatccatgcccttctcccaggacgagaccagaggcagactcagggggttgcgcacgttcaggacaccgggggtcgcgggctcgacgatgcgttttccgtccttgccttccttcaacagaaccggcggctggctgaatcccactcccacgatcacggcatcttcctggggcatctcttcgtcggggtctaccttggtcacatgcttggtcttcctggcttgcttcttttttggagggctgtccacggggaccacgtcctcctcggaagacccggagcccacccgctgatactttcggcgcttggtgggcagaggaggtggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaagctcatgctggccgtggtcctggtcaccctcgagctcgaatgcatgcgccgcttcttcaccgaccccgagaccctgcgcaaagtcgaggagaccctgcactacactttcagacacggcttcgtcaggcaggcctgcaagatctccaacgtggagctgaccaacctggtctcctgcctggggatccttcacgagaaccgcctggggcagaccgtgctccactctaccctgaagggcgaggcgcgtcgggactatgtccgcgactgcgtctttctctttctctgccacacatggcaagcagccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtttttcccgaacgcctgaggcagacgctgaaaggcgggctgcccgacttcatgagccagagcatgttgcaaaactaccgcacttttattctcgagcgctcggggatcctgcccgccacctgcaacgccttcccctccgactttgtcccgctgagctaccgcgagtgtcccccgccgctgtggagccactgctacctcttgcagctggccaactacatcgcccaccactcggatgtgatcgaggacgtgagcggcgaggggcttctcgagtgccactgccgctgcaacctgtgctccccgcaccgctccctggtctgcaacccccagctcctaagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggcctgaggatcgcggcgaacgagcccttgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctgactcttaaagactaaggcgcgccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagcagggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctgaaataagactctactctgggatcaagtgtcgtcataatcgcaccgagaccatcaacttcaccacccaggaacaggtgaactttacctgcaaaccccacaagaagtacctcatctggttcttcgagaacactactcttgcagtagttaacacctgtgacaacgacggtgttcttcttcccaacaatctcaccagtggactagccttctctgttaaaagggcaaagctaattcttcatcgccctattgtagaaggaacttaccattgtcagagcggaccttgtcaccacattttccatttggtgaacgtcaccagcagcagcaacagctcagaaactaacctctcttctcgtactaacagacctcaattcggaggtgagctaaggcttcccccttctgaggagggggttagtccatacgaagtggtcgggtatttgattttaggggtggtcctgggtgggtgcatagcagtgctagctcagctgccttgctggatcgaaatcaaaatctttatctgctgggtcagacattgtggggaggaaccatgaaggggctcttgctgattatcctttccctggtggggggtgtactgtcatgccacgaacagccactatgtaacatcaccacaggcaatgagagaagcgaatgctctgtagttatcaaatgtgagcacaaatgttctctcaacattacattcaagaataagaccatgggaaatgtatgggtgggcttctggcaaccaggagatgagcagaactacacggtcactgtccatggtagcgatggcaatcacactttcggtttcaaattcatttttgaagtcatgtgtgatatcacactgcatgtggctagacttcatggcttgtggccccctaccaaggagaacatggtgggtttttctttggcttttgtgatcatggcctgctttatgtcaggtctgctggtaggggctctagtgtggtttctgaagcgcaagcccagatatggaaatgaggaaaaggaaaaattgctataaatctttttctcttcgcagaaccatgaatactttgaccagtgtcgtgctgctctctcttcttgtagcttttagtcaaggactattagaatctaaagttgtaaaaataccatatggcagtacctatgttttagttggaccaagagatccaccagttcaatggtttgggggtggagattttactatgttctgtaatggaagtaaaactcacttgcaaaacataagacacacttgtaatgaacagaacctgactttactgtcagttggctatggccatagaggtgattactatggttttagacatgataacacaggcagaaaacattataaggttataatcgaagcacctccgccagtaaccagaaaaccactttcagaaataaaatatgttaatgttaccatgggtcaaaatctaacactaagtggaccaccaggaacgccagttacatggcatggagagggtcacaaactttgcgaaggcaaaaatgttttctatcgcgaacttaaccacacttgtacagaaaaggaccttatcctgttatttgtaaacagaactcataatggtccttatattggttacaacaaagaaggtacagacagagagcattatgaagtatcagtgttagatttaatgccaattgcaggacaaggtttggattcaaaaaataaagaacaaaaaatacctcctaaaagaaaatcaaaagataaagtcaaagaagttaactttccaacaggaactgatcagacactaattggacctcctgggcaaaaaattgattggcatgtgagcagtaatgatggtcagtttaaaaaactgtgtgaaactaaagatggaaaacattcttgccatgggcggaacataacaatattcaacattagcagagcagatgaagggtcttattatggctccagccatgatggttcgtcgcactacaaagttactgtgtatgacaaatcaagctttggtaaagcaaaaatcaaaattgatccatacaccacaaagggaacaaccactgaaaattatcacgagtttgaattacaacagggaaatgatgaatcagacgatcaaaaacaaattccttcaactactgtggctatcgtggtgggtgtgattgcgggcttcgtaactctgatcattgtctttatctgctacatctgctgccgcaagcgaccaaggtcatacaatcatatggtagacccactactcagcttctcttactgaaactcagttactctcatttcagaaccatgaaggctttcacagcttgcgttctgattagcttagtcacacttagtctatctcaaatgattaatgttaatgttaccagaggaggtagtattacattgaatggaacttacaaagatactacatggacaagatatcacttagactcatggaaaaatttatgcgagtggaacattacagcttacaaatgttatgaaaatggaagcattactatcactgccactggtgatattacatctggcagatacaaggcagaaagttacaaaaatgaaattaaaaaatcaatattaaaaactaataaaactacatttgaagattctggaaactatgaacatcaaaaaataactttctatcagctaacaataatcgaactacctactactaaggcatccaccacagttagatcaacccagcctactacagtcagtacaacgattgaaagcactactcacactacacagttagacactacagtgaagaacagtactgtgttggttaggtttttgtttagggaggaaagtactactgaacagacagaggctacctcaagtgccttcagcagcactgcaaatttaacttcgcttgcttcggtaaatgagacgatcgtgccgatgatgtatggccaacattacccaggtttggatatgcaaattactttcctgattgtctgtggggtctttatcctcactgtccttctctactttgtctgctgcaaggccagagaaaaatctaggcggcccatctacaggccagtaatcggggaacctcagcccctccaagtggatggaggcttaagaaatcttctcttctcttttacagtatggtgatcagccatgattcctaggttcttcctatttaacatcctcttctgtctcttcaacatctgcgctgccttcgcggccgtctcgcacgcctcgcccgactgtctagggcctttccccacctacctcctctttgccctactcacctgcacctgcgtctgcagcattgtctgcctggtcattaccttcctgcagctcatagactggtgctgcgcgcgctacaattacctgcatcatagtcccgaatacagggacgagaacgtagccagaatcttaaggctcatatgaccatgcagactctgctcatactgctatccctcctatcccctgtcctcgctgatgattactctaaatgcaaattcgcggacatatggaatttcttagactgctatcaggagaaaattgatatgccctcctattacttggtgattgttggggtagtcatggtctgctcctgcactttctttgccatcatgatctacccctgttttgatctcggctggaactctgttgaggcattcacatacacactagaaagcagttcactagcctccacgccaccacccacaccgcctccccgcagaaatcagtttcccatgattcagtacttagaagagccccctccccggcccccttccactgttagctactttcacataaccggcggcgatgactgaccaccacctggatctcgagatggacgggcaggcctccgagcagcgcatcctgcaactgcgcgtccgtcagcagcaggagcgggccgccaaggagctcctcgatgccatcaacatccaccagtgcaagaagggcatcttttgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctcctcaagaccctttgcggactccgcgacctcctccccatgaactgatgttgattaaaagcccaaaaccaatcagccccatccccaattactcataagaataaatcattggaattaatcattcaataaagatcacttacttgaaatctgaaagtatgtctctggtgtagttgttcagcagcacctcagtaccctcctcccagctctggtactccagtccccggcgggcggcaaacttcctccacaccttgaaagggatgtcaaattcctggtccacaattttcattgtctttcctctcagatgtcaaagaggctccgggtggaagatgacttcaatcccgtctacccctatggctacgcgcggaatcagaatatccccttccttactcccccctttgtctcctccgatggattccaaaacttcccccctggggtcttgtcactcaaactggctaacccaattgctatcaccaatgggaatgtctcactcaaggtgggaggaggactcactgtagaacaagactctggaaacctaagtgtgtcccctaaacctccattgcaaattggaacagacaaaaaactggaattggctttggcacctccatttgatgttaaagagaacaagctatctttgctagtaggagatggattaaagataatagatagatcaatatctgatttgccaggattgttaaactatcttgtagttttaactggcaaaggaattggaaatgaagaattaaagaataacgatggtagtaataaaggagtcggtttatgtgtgagaattggagaaggaggtggtttaacttttgatgataaaggttatttagtggcatggaacaataaacatgacatccgcacactttggacaactttggacccttctccaaattgcaaaatagatctagaaaaagactcaaaactaactttggtactgacaaaatgcggaagtcagattttggcaaatgtatctctaattatagttaaaggaaagtttcagaaccttaacaacaaaacaaacccaaccctacctaaaacatttagcatcaaactactgtttgatcgaaatggagttctattggaaaactcaaacattgaaaaacagtacctaaactttagaagtggagactcaattcttccaaatccatataaaaatgcaattgggtttatgcctaatttattagcttattctaaatctacaactgatcagtctaaaatttatgcaaggaacactatatatggaaatatatacttagataatcagccatataatccagttgtaattaaagttacttttaataatgaagcagatagtgcttattctatcacttttaactattcatggaccaaggactatgataatatcccttttgattctacttcatttaccttctcctatatcgcccaagaatgaaagaccaataaacgtgtttttcatttgaaaatttcatgtatctttatttatttttacaccagcacgggtagtcagtttcccaccaccagcccatttcacagtataaacaactctctcagcacgggtggccttaaatagggaaatattctgattagtgcgggaactggacttagggtctataatccacacagtttcctggcgagccaaacgggggtcggtgattgagatgaagccgtcctctgaaaagtcatccaagcgggcctcgcagtccaaggtcacagtctggtggaatgagaagaacgcacagattcatactcggaaaacaggatgggtctgtgcctctccatcagcgccctcaacagtctttgccgccggggctcggtgcggctgctgcagatgggatcgggatcgcaagtctctctgactatgatccccacagccttcagcatcagtctcctggtgcgtcgggcacagcaccgcatcctgatctcgctcatgttctcacagtaagtgcagcacataatcaccatgttattcagcagcccataattcagggtgctccagccaaagctcatgttggggatgatggaacccacgtgaccatcataccagatgcggcagtatatcaggtgcctgcccctcatgaacacactgcccatatacatgatctctttgggcatgtttctgttcacaatctgccggtaccaggggaatcg

SEQ ID NO: 1430 - DNA, 32767 bp, Human mastadenovirus D
ataatataccccacaaagtaaacaaaagttaatatgcaaatgagcttttgaattttaacggtttcggggcggagccaacgctgattggacgagaagcggtgatgcaaatgacgtcacgacgcacggccgacggtcgccgcggaggcgtggcctagcccggaagcaagtcgcggggctgatgacgtataaaaaagcggactttagacccggaaacggccgattttcccgcggtcacgcccggatatgaggtaattctgggcggatgcaagtgaaattaggtcattttggcgcgaaaactgaatgaggaagtgaaaagtgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaagaggctgtgaatttaatatttccagaatctatgattctccaggctgacatagctagcgaagctatagttactccacttcataccccaactctgccgcccatacctgaattggaagaggaggatgagatagacctccggtgctacgaggaaggttttcctcccagcgattcagaggacgaacagggtgagcgagagatggctattctatcggactttgcttgtgtgattgtggaggagcaagatgtgattgaaaaatctactgagccagtacaaggctgtaggaactgccagtaccaccgggataagtccggagatgtgaacgcctcctgcgctctgtgctatatgaaacagactttcagctttatttacagtaagtggagtgaatgtgagagaggctgagtgcttaacacataactgtaatgcttgaacagctgtgctaagtgtggtttatttttgttactaggtccggtgtcagaggatgagtcatcaccctcagaagaagaccacccgtctccccctgagctgtcaggcgaaacgcccctgcaagtgcacagacccaccccagtcagacccagtggcgagaggcgagcagctgttgaaaaaattgaggacttgttacatgatatgggtggggatgaacctttggacctgagcttgaaacgccccaggaactaggcgcatatgcgcttagtcatgtgtaaataaagttgtacaaataaaaagtatatgtgacgcatgcaaggtgtggtttatgactcatgggcggggcttagtcctatataagtggtaacacctgggcactcaggcacagaccttcagggagctcctgatggaggtgtggactatccttgcggactttaacaagacacgccggcttgtggaggatagttcagacgggtgctccggtttctggagacactggtttggaactcctctagctcgcctggtgtacacagttaagaaggattatcaggaggaatttgaaaatctttttgccgactgttctggccttcttgattcactgaatctcggccaccaggctctattccaggaaagggtcctccacagccttgatttttccagcccagggcgcactacagccggtgttgcttttgtggtgtttctggttgacaaatggagccagcaaacccacctaaccagggattacatcctggacttcacggccatgcatctgtggaaggcctgggtcaggcagcggggacagagaatcttgaactactggcttctacagccagcagctccgggtcttcttcgtctacacagacaaacatccatgttggaggaagagatgagggaggccatggacgagaacccgaggagcggcctggaccctccgtcggaagaggagctggattgaatcaggtatccagcttgtacccagagcttagcaaggtgctgacaaccatggccaggggagtgaagagggagaggagcgatgggggcaatactgggatgatgaccgagctgacagccagcctgatgaatcgcaggcgacctgagcgcattacctggcatgagctacagcaggagtgcagggatgagataggcctgatgcaggataaatatggcctggagcagataaaaacccactggttgaacccagatgaggattgggaggaggccattaagaaatatgccaagatagccctgcgcccagattgtaagtacagggtgaccaagacggtgaatatcagacatgcctgctacatctcagggaacggggcagaggtgatcatcgataccctggataaggctgccttcaggtgttgcatgatgggaatgagagccggtgtgatgaatatgaattcaatgatattcatgaacatcaagttcaatggagagaagtttaatggggtgctgttcatggccaacagccacatgaccctgcacggctgtaatttctttggctttaacaacatgtgtgcagaagtctggggtgcttccaagatcaggggctgtaagttttatggctgctggatgggagtggtcggaagacccaagagcgagatgtctgtgaagcagtgtgtgtttgagaagtgctacctggccgtgtctaccgagggcaatgctagagtgagacattgctcttccatggagacgggctgcttctgcctggtgaagggcacagcttctatcaagcataatgtgatcaaggggtgtactgatgagcgcatgtacaacatgctgacctgcgactctggggtctgccatatcctgaagaacatccatgtgacctcccaccctaggaagaggtggccatcatttgaaaataatgtcctgatcaagtgccatgtgcacctgggagccagaaggggtaccttccagccgtaccagtgcaactttagccagaccaagctgctgctggagaatgatgccttctccagggtgaacctgaacggtatctttgacatggatgtctcggtgtacaagatcctgagatacgatgagaccaggtccagggtgcgcgcttgcgagtgcgggggcagacacaccaggatgcagcctgtggctctggatgtaaccgaggagctgaggcccgaccacctggtgatggcctgtaccgggaccgagttcagctccagcggggaggacacagattagaggtaggttgagtattagtgggcgtggctaaggtgactataaaggtgggtgtcttacgagggtctttttgcttttctgcagacatcatgaacgggaccggcggggccttcgaaggggggcttttcagcccttatttgacaacccgcctgccgggatgggccggagttcgtcagaatgtgatgggatctacggtggatgggcgcccagtgcttccagcaaattcctcgaccatgacctacgcgaccgtggggacgagctcgtcgcttgacagcaccgctgcagccgcggcagccgcagccgccatgacagcgacgagattggcctcgagctacatgcccagcagcggtagcagcccctctgtgcccagttccatcatcgccgaggagaaactgctggccctgctggccgagctggaagccctgagccgccagctggccgccctgacccagcaggtgtccgatctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtgcagtttggcctggatcttgaggttggcgatgttgccgcccagatcccgcctggggttcatgttgtgcaggaccaccaggacggtgtagcccgtgcacttggggaacttatcatgcaacttggaagggaatgcgtggaagaatttggagacgcccttgtgaccgcccaggttttccatgcactcatccatgatgatggcaatgggcccgtgggctgcggctttggcaaagacgtttctggggtcagagacatcataattatgctcctgggtgagatcatcataagacattttaatgaatttggggcggagggtgccagattgggggacgatagttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtatatgaccccgatgacgggttgcaggtggtagttcaaggacatgcagctgccgtcgtcccggaggaggggggccacctcgttgagcatgtctctgacttggaggttttcccggacgagctcgccgaggaggcggtccccgcccagtgagagcagctcttgcagggaagcaaagttttttaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacataggagggattgcagggcgtatagcttgggcgcgagaaagaccgactcgggggcgaaggcgtccgctccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagatggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcaagcacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgaaagcgggcatgacctcggcactcaggttgtcagtttctagaaacgaggaggatttgatgttggcctgccctgccgcgatgcttttcaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcgatgttgagctggacatactcgcgcgcgacgcacttccattcggggaagacggcggtgcgatcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgttcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgcgtgagggcggaggcgtacatgccgcagatgtcgtagacatagatgggctccgagaggatgccgatgtaggtgggataacagcgccccccgcggatgcttgcgcgcacgtagtcatacaactcgtgcgatggggccaagaaagcggggccgagattggtgcgctggggctgctcggcgcggaagacgatctggcgaaagatggcgtgcgagttggaggagatggtgggccgttggaagatgttaaagtgggcgtggggcaggcggaccgagtcgcggatgaagtgcgcgtaggagtcttgcagcttggcgacgagctcggcggtgacaaggacgtccatggcgcagtagtccagcgtttcgcgaataatgtcataacccgcctctcctttcttctcccacagctcgcggttgagggcatactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaaatccgagtcgtcgcagccaccgtgctcccagagctcgaaatcggtgcgcttcttcgagagcgggttaggcagagcgaaagtgacatcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcggacggcctttgatgtgaggcagctttttgagctcctcgtaggtgaggtcctcgggacattgcaagccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctctgggtcccccgagaatttcatgaccagcatgaaggggacgagctgtttgccaaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaacagagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatttcttgcacgtcgcccgagttgtcctggtaggcaatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaatacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcctcctctgggggtggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagagttgcggttgctgatgatgtaattaaagtaggcgtttttaaggcggcggatggtggcgaggaggaccaggtccttgggtcccgcttgctggatgcggagccgctcggccatgccccaggcctggccctgacaccggctcaagttcttgtagtagtcatgcatgagcctctcgatgtcatcactggcggaggcggagtcttccatgcgggttaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggctgcacgacctcggagtacctgagccgcgagaaggcgcgcgagtcgaagacatagtcgttgcaggtgcgcacgaggtactggtagccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtcacctcgaatcaggctggagccgcgactaacgtggtattggcactcccgtctcgacccgagcccgatagccgccaggatacggcggagagccctttttgccggccgagtggggtcgctagacttgaaagcggcggaaaaccctgccgggtagtggctcgcgcccgtagtctggagaagcatcgccagggttgagtcgcggcagaacccggttcgcggacggtcgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcaaccgcggccgtagcaggcgccggcgctagccagccacagccacagacagagatggacttggaagagggcgaagggctggcaagactgggggcgccgtccccggagcgacacccccgcgtgcagctgcagaaggacgtgcgcccggcgtacgtgcctccgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctaacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggaagaggatgaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctataacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctcatggtgaccgaggtgccccagagcgaggtgtaccagtctggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtaaaccgcaactcgtacctgggtcacttgctaacgctgtaccgcgaggccataggccaggcacaggtggacgagcagaccttccaggagatcacaagcgtgagccgcgcgctggggcagaacgacaccgacagtctgagggccaccctgaacttcttgctgaccaatagacagcagaagatcccggcgcagtacgcgctgtcggccgaggaggaaaggatcctgagatatgtgcagcagagcgtagggcttttcctgatgcaggagggggccacccccagcgccgcgctggacatgaccgcgcgcaacatggaacctagcatgtacgccgccaaccggccgttcatcaataagctgatggactatctgcaccgcgcggcggccatgaactcggactactttactaatgctatactaaacccgcactggctcccgccgccggggttctacacgggcgagtacgacatgcccgaccccaacgacgggttcctgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaacttaaccgctggaagacctacgctcaggaccatagagaacctgcgcccgcgccgcggcgacagcgccacgaccggcagcggggcctggtgtgggacgacgaggactcggccgacgatagcagcgtgttggacttgggcgggagcggtggggtcaacccgttcgcgcatttgcagcccagactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaaaaggcggaaggggctgatgcaaatgatagaagcaaggatattttagagtatgaatggtttgagtttaccctgcccgagggcaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagtagggggcaacatccccgccctgcttgatgtgcccaagtacttggaaagcaagaagaaactggaggaagccgctaaggaatctggcaataccaaagctgaggaagaggctgctaaaaaagagctagttattttgccagtaacagaagatgaaagcaaaagaagctataatttaattcagggaaccacagacacgctgtaccgaagctggtacctgtcctatacctacggggaccccgagaagggggtgcagtcgtggacgctgcttaccacccctgatgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttctaccgccgccgccgtgcgcaccaccgtcgacgacgttatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccaccggagcacgcccgccatgcgcgccgctcgggctctgctgcgccgcgccagacgcacgggccgccgggccatgatgcgagccgcgcgccgcgctgccgctgcaccccccgcaggcaggactcgcagacgagcggccgccgccgccgccgcggccatctctagcatgactagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgcgttgcggcccggcacggcggtggtattcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgcttccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggcttccaacctccaccgctaccgcctccacttctaccgccgccacggctaccgagcctcccaggaggcgaagatggggcgccgccagccggctaatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagatgttgagggaaaagctcgcagaccagaacttccagcagaaggtggtggacgggctggcctcgggcattaacggggtggtggacatcgcgaaccaggccgtgcagcgcgagataaacagccgcctggacccgcgtccgcccacggtggtggagatggaagatgcaactcttccgccgcccaagggcgagaagcgaccgcggcccgacgcggaggagacgaccctgcaggtggacgagccgccctcgtacgaggaggctgtcaaggccggcatgcccaccacgcgcatcatcgcgccgctggccacgggtgtaatgaaacccgccaccctagacctgcctccaccacccacgcccgctccaccgaaggcaactccggttgtgcagccccctccggtggcaaccgccgtgcgccgcgtccccgcccgccgccaggcccagaactggcaaagcacgctgcacagtatcgtgggcctgggagtgaaaagtctgaagcgccgccgatgctattgagagagaggaaagaggacactaaaggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactctggcacggcctacaacagcctggcccccaagggcgcccccaatcccagtcagtggactacgaaagagaataatggtcaacaaaaagaaataacgcacacttttggtgtggctgctatgggaggggaatcaatagataaagataaaggtttacaaattggaactgaagaaacaacagacaatggacagcaaaagatctatgcaaataaaatcttccagccagaacctcaagtaggagaggataactggagtgaaaattacccagtttatggcggaagagcgcttaagaaagataccaagatgaagccttgctatggctcgtttgctagacctactaatgaaaaaggtgggcaggcgaaactaaaggacccagaaaataaccagaaagaattcgacatcgacttggctttctttgatccaaatgacatcaacactccagacgttgtgctttacactgaaaatgcacatctggaaacaccagacacccatgtggtgtataaagctggcaaagaagacgacagttccgaaatcaacctggttcagcagtccatgccaaacaggcccaactacatcggcttcagggacaactttgtggggctcatgtattacaacagcactggcaacatgggtgtgctggccggccaggcctctcagttgaatgctgtggttgatttgcaagacagaaacacagagctgtcttaccagctattgctagattctctgggtgacagaaccagatactttagcatgtggaactctgcggtggacagctatgatcccgatgtcaggatcattgagaatcacggtgtggaagatgaacttccaaactattgcttcccattggatggagtggcaactaatgcagttttccaaggtgttaaacctgatccagctgctggtgatcaagacaaatgggttaaggatgaaaacagcgatgaacataacagaataggcaagggaaacatctatgccatggagatcaacctccaggccaacctgtggaagagttttctgtactcgaacgtggccctgtacctgcccgactcatacaagtacacgccggccaacgtcacgctgcccaccaacaccaacacctacgactacatgaacggccgcgtggtagccccctcgctggtggacgcctacgtcaatatcggcgcgcgctggtcgctggaccccatggacaatgtcaaccccttcaaccaccaccgcaatgcgggtctgcgctaccgttccatgcttctgggcaacggccgctacgtgcccttccacatccaagtgccccaaaagttctttgccatcaagaacctgcttctgcttcccggctcctacacctacgagtggaacttccgcaaggacgtcaacatgatcctgcagagttccctcggaaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctgtcggccgccaacatgctctaccccatcccggccaaggccaccaacgtgcccatctccatcccctcgcgcaactgggccgccttccgcggctggagtttcaccaggctcaagaccaaggaaactccctccctgggctcgggtttcgacccatactttgtctactcgggctccattccctacctcgacggaaccttctacctcaaccacactttcaagaaggtctccatcatgttcgactcctcggtcagctggccaggcaacgaccggctgcttacgccgaacgagttcgagatcaagcgcagcgtcgacggggagggctacaacgtggcccaatgcaacatgaccaaggactggttcctcgtccagatgctctcccactacaacatcggctaccagggcttctacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctacccgctcatcggccagacagccgtgccctctgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgtgccatcgtcaacacggccggccgcgagaccgggggcgtgcactggctcgcctttggctggaacccgcgctcgcgcacctgctacatgttcgacccctttgggttctcggaccgccggctcaagcagatttacagcttcgagtacgaggccatgctgcgccgcagcgccctggcctcctcacccgaccggtgtctcagcctcgagcagtccacccagaccgtgcaggggcccgactccgccgcctgcggacttttttgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgatcccaccgcgccgccattgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggaacttgggctgccacttgaactcggggatcaccagtttgggcactggggtctcggggaaggtctcgctccacatgcgccggctcatctgcagagcgcccagtatgtcaggcgcggagatcttgaaatcgcagttggggccggtgctctgcgcgcgcgagttgcggtacacggggttgcagcactggaacaccatcagactggggtacttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggccgagatctgcttgaaagcttgctgggccttggccccctcgctgaagaacagaccgcagctcttcccgctgaactggttattcccgcacccggcatcatggacgcagcagcgcgcgtcatggctggtcagttgcaccacactccggccccagcggttctgggtcaccttggccttgctgggctgctccttcagcgcgcgctgcccgttctcgctggtcacatccatctccaccacgtggtccttgtggatcatcaccgttccatgcagacacttgagctggccttccacctcggtgcagccgtgatcccacagggcgcagccggtgcactcccagttcttgtgcgcgatcccgctgtggctaaagatgtaaccttgcaacaggcgacccatgacggtgctaaatgctttctgggtggtgaaggtcagttgcatcccgcgggcctcctcgttcatccaggtctggcacatcttttggaagatttcggtctgctctggcatgagcttgtaagcatcgcgcaggccgctgtcgacgcggtagcgttccatcaacacgttcatggcatccatgcccttctcccaggacgagaccagaggcagacttagggggttgcgcacgttcaggacaccgggggtcgcgggctcgacgatgcgttttccgtccttgccttccttcaacagaaccggcggctggctgaatcccactcccacgatcacggcgtcttcctggggcatctcttcgtcggggtctaccttggtcacatgcttggtctttctggcttgcttcttttttggagggctgtccacggggaccacgtcctcctcggaagaccccgagcccacccgctgatactttcggcgcttggtgggcagaggaggcggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagtgaaacccccctcagcgtcgaggagctgtgtcgggcctacgagctcaacctcttctcgccgcgcgtgccccccaaacgccagcccaacggcacatgtgagcccaacccgcgtctcaacttctatcccgttttcgcggtccccgaggcccttgccacctatcacatctttttcaagaaccaaaagatccccgtctcctgccgcgccaaccgcacccgcgccgacgcgctcctcgctctggggcccggcgcacgcatacctgatatcgcttccctggaagaggtgcccaagatcttcgaagggctcggtcgggacgagacgcgcgcggcgaacgctctgaaagaaacagcagaagaagagggtcacactagcgccctggtagagttggaaggcgacaacgccaggctagccgtgctcaagcgcagcgtcgagctcacccacttcgcctaccccgccgtcaacctcccgccaaaggtcatgcgtcgcatcatggatcagctcatcatgccccacatcgaggccctcgatgaaagtcaggagcagcgccccgaggacgcccggcccgtggtcagcgacgagcagctcgcgcgctggctcgggacccgcgaccaccagaccctggagcagcggcgcaaactcatgctggccgtggtcctggtcaccctagagctggaatgcatgcgccgcttcttcagcgaccccgagaccctgcgcaaggtcgaggagaccctgcactacactttcaggcacggtttcgtcaggcaggcatgcaagatttccaacgtggagctgaccaacctggtctcctgcctgggaatcctgcacgagaaccgcctggggcagaccgtgctccactcgaccctgaagggcgaggcgcggcgagactatgtccgcgactgcgtctttctatttctctgccacacatggcaagcagccatgggcgtgtggcagcagtgtctcgaggatgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatctgggatgctacccgccacctgcaacgctttcccctccgactttgtcccactgagctaccgcgagtgtcccccgccgctgtggagccactgctatctcttgcagctggccaactacattgcctaccactcggacgtgatcgaggacgtgagcggcgaggggctgctcgagtgccactgccgctgcaacctgtgctccccgcaccgctccctggtctgcaatccccagctcctaagcgagacccaggtcattggtaccttcgagctgcaaggtccgcaggagtccaccgctccgctgaaactcacgccggggttgtggacttccgcgtacctgcgcaaatttgtacccgaggactaccacgcccatgagataaaattcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggaaccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgtagccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctattttgagtttcccgaggagcaccccaacggccctgcacacggagtgcggatcaccgtagagggcaccaccgagtctcacctggtcaggttcttcacccagcaaccattcctggtcgagcgggaccggggcgccaccacctacaccgtctactgcatctgtcctaccccgaagttgcatgagaatttttgctgtactctttgtgctgagtttaataaaagctgaaataagaatcttctctggaccttgtcatcgacctcggaatcgcaccgtcttactcaccaaccagaccaaggttcgtcttaactgtgcaaccaacaggaagtaccttctttggtccttccaaaacacctcactcgctgttgtcaacgcccgtgacgacgacggtgttttaatcccaaacaacctcaccagtggacttactttctctaccaacaaaacaaagctcatccttcaccacccttttgtagagggaacctaccagtgccgacacggaccttgtgttcacaacttccatttggtgaaccttaccagcagcagtacagttgctcctgaaacaactaacctttcttctgatactaacaaacctcgtgtcggaggtgagctttgggttccctctctaacagagggtgggaaacatattgaagtggttgggtatttgattttaggggcggtcctgggtgggtgcatagcagtgctatatcaacttccttgctgggtcgaaatcaaaatctttatctgctgggtcagacattgtggggaggaaccatgaaggggctcttgttgattatcctttccctggttgggggtgtactgtcatgccacgaacagccacgatgtaacatcaccacaggcaatgagagaagcgaatgctctatagtgatcaaatgtgagcacaaatgttctctcaacatcacattcaagaataagaccatgggaaatgtatgggtgggattctggcaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggagaacatggtgggtttttctttggcttttgtgatcatggcctgctttatgtcaggtctgctggtaggggctctagtgtggttcctgaagcgcaagcccaggtacggaaatgaggagaaggaaaaattgctataaatctttttcttttcgcagaaccatgaatacagtgatccgtatcgtgctgctctctcttcttgtagcttttagtcagggaaaaacagaacgtaaaaatatcactgttgaatggggaaaggatgtaatactagtcggaccacaagatctgccagttaattggcacgggcctagaaatgaactttgtaagggaactgaaactcttcataggcagcttagtcataagtgtgatgggcagaatttaacacttataagagttaataacacttttcagggtacatattatggttttagaaaagatggaactggaatgaaccaatatacagttaaagtttatgcaccaaaggcctatactcgcaaaccattgccaaaaacaatacaatatgatgtatacaaaggccaaaatattacactaacaggacctccatatgatcatgtcgattggtatggtccgactcaccaactttgtaatggtgatgagactttacatccagaaattaatcacacatgcactaaacaaaacctaacgcttacatttgtaaattcgacttactggggcgcctattatggaataaacaaagatggagatgacagaacaagttatgaggttactgtgttagatggttatgaaaatgcagggcaacataaagatgaagacccagaaattgaaaactctagagagcagactaaaccaaaaacaaaaagcaaaagtgcccaaaagacaaacaagcataggccagacaagcagctcaaaaaagatattgaaaaagatttcgctagcggaaccaatcaaactttagtgggtccaccaggttcaaaaactgaatggtataatggaaaacttgacaaactgtgcggtggaaagactggtttaaagattttgtgtaatgatcagaacattacattgatcaatgtaaatgaaacatatgcaggaacctattatggttctaacaaagatgaccataggcagtacagagttactgtttatacaagaccacgtaatgaaactgtgagaattcaaccatacaccactaagggaactacaaaaacaaccttaggtaatcacagctttgaactgcaattgggaaatggcgaatcagaagatgatcaaaaacaaattccatctactactgtggcaatcgtggtgggtgtgattgcgggcttcataactataatcattgtcattctgtgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagtttagctgctaagagagaacaataccatagttacaatgttactagaaatggatttataacgttaaatgtaacaattgaaaatacaacatggacgcgttatcatcaagatggatggaaacaaatttgtttgtggaaagatccatcttacacatgtcacacaaataatggaagcattactattcatgccttcaatattacttctggacaatatagagctgaaagctacacttactggtataaatattatggtaatcataaacatgaaattcatatttttaacataactgtgattgagcatcctacaacaaaagcgccaaccactgctaatacagccacattaaccacacagcctactactaggaaaacaactacacagtcaactactagggagacaacgcggccaaccacacatcaaaccaccacagccagtacaactgctgagaccactactcatactacacagctagacactacagtgcagaatagtactgtgttggttaggtttttgttgagggaggaaagtactactgaacagacagaggctacctcaagtgccttcagcagcactgcaaatttaacttcgcttgcttcaataaatgagaccctcgtgccgatgaaacaggatcaacctaattactcaggtttggatatgcaaattactttcttaattgtctgtggggtctttattcttgtggttcttctttactttgtcttttgcaaagccagacaaaaatctcatagaacaatctacaggccagtgatcggggaaccccagccactccaagtggatggaggcttaagaaatcttctcttctcttttacagtatggtgatcagccatgattcctaggtttttcctatttaacatcctcttctgtctcttcaacatctgcgctgcattcgcggccgtctcgcacgcctcgcccgactgtctcgggcccttcccaacctacctcctctttgccctgctcacctgcacctgcgtctgcagcattgtctgcgtggttatcaccttcctgcagctcatcgactggtgctgcgcgcgctacaattacatacagcacagtcccgaatacagggacgagaacgtagccagaatattaaggctcatctgaccatgcagactctgctcatactgttatccctcctatcccctgccctcgctactaaagactattctcaatgtaaatttgcggacatatggaatttcttagaatgctatgatgcgaaaattgatatgccctcctattacttggtgattgttggggtagtcatggtctgctcatgcactttctttgccattatgatctacccctgttttgatctcggctggaactctgttgaagcattcacatacacactagaaagcagttcactagcctccacgccaccacccacaccgcctacccgcagaaatcagtttcccctgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactgatgttgattaaaagcccagaaaccaatcagccccttccccatccccaattactcataagaataaatcaatggaattaatcattcaataaagatcacttacttgaaatctgaaagtatgtctctggtgtagttgtttagcagcacctcagtaccctcctcccagctctggtactccaatccccggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaacttcccccctggtgtcctgtcgctcaaactggctaacccaatcaccattgccaatggaaatgtttcacttaaggtgggagggggacttactttgcaagatgtaactggagacctaacagtcaatgctaagacacccttgcaagttgcagatgataaaaaacttgagcttgcttacggtgagccttttgaaataaagaatggcaaacttgcaataaaaacaggtcatggattaaaggttataaatgaagaaatttcaacattaccaggtttggcaggacaccttgtagttttaactggagttggaattggcactgagacacttaaagacaaagacgataaagtaattggatctgctgtaaatgtaagacttggaaaagatggtggtcttgattttaataaaaaaggagacttggttgcctggaacagagataatgacaggcgtactctttggaccactccagatccatctccaaattgcaaggtcagcgaagcaaaggattctaaactaactttagtattaaccaagtgtggaagtcagattttagctagtgttgcactgcttattgttaaaggaaaataccaaacaataagcgaatcaaccataccaaaaaacgaaagaaactttagcattaagctgatgtttgatgacaaaggaaagcttcttaacacgtccagtctggataaggaatattggaacttcagaagcaatgacagtgttgttggaactgcttatgataatgcagtaccatttatgcctaatctaaaagcatatccaaaaaatactacaacgtcttccacaaatccagatgataaaataagtgctgggaaaaagaacattgtgtcaaatgtgtatcttgaaggaagggtatatcagccagtggctttaactgtaaaatttaacagtgaaaatgattgtgcttattccattacatttgactttgtttggagcaagacatatgaatctcctgtggcatttgatagctcctcatttaccttctcatatattgcccaagaaaacaaagacacggacgaataaagtgtttttaaaaagaattatgtatctttattgatttttacaccagcacgggtagtcagtctcccaccaccagcccatttcacagtataaacaattctttcagcacgggtggccttaaataggggaatgttctgattagtgcgggaactgaacttggggtctataatccacacagtttcctggcgagccaaacgggggtcggtaattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcaacagtctctgccgccggggctcggtgcggctgctgcagatgggatcgggatcacaagtctctctgactatgatccccacagccttcagcatcagtctcctggtgcgtcgggcacagcaccgcatcctgatctctgccatgttctcacagtaagtgcagcacataatcaccatgttattcagcagcccataattcagggtgctccagccaaagctcatgttgggaatgatggaacccacgtgaccatcgtaccagatgcggcagtatatcaggtgcctgcccctcatgaacacactgcccatatacatgatctctttgggcatgtttct

SEQ ID NO: 1431 - DNA, 32767 bp, Human mastadenovirus D
ataatataccccacaaagtaaacaaaagttaatatgcaaatgagcttttgaattttaacggttttggggcggagccaacgctgattggtcgaaagaagacgatgcaaatgacgtcacgacgcacggccgacggtcgccgcggaggcgtggcctagcccggaagcaagtcgcggggctgatgacgtataaaaaagcggactttagacccggaaacggccgattttcccgcggccacgcccggatatgaggtaattctaggcggatgcaagtgaaattaggtcattttggcgcgaaaactgaatgaggaagtgaaaagtgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagccgagcccgtcaagaggccactcttgagtgccagcgagtagagatttctctgagctccgctcccagagaccgagaaaaatgagacacctgcgcctcctgcctggaactgtgcctatggacatggccgcattattgctgcaggactttgtggatacagtattggaggacgaactgcaaccaactccgttcgagctgggacccacacttcaggacctatatgatctggaggtagatgcccaggatgacgacccgaacgaagaggctgtgaatttaatatttccagaatctctgattcttcaggctgacatagccagcgaagctgtacctacaccacttcatacaccgactctgtcgcccatacctgaattggaagaggaggacgaactagacctccggtgttatgaggaaggttttcctcccagcgattcagaggacgaacggggtgagcagagtatggctataatctcagactatgcttgtgtggttgtggaagagcattttgtgttggacaatcctgaggtgccagggcaaggatgtagatcctgccaatatcaccgggatcagaccggagacccaaatgcttcctgcgctctgtgttacatgaaaatgagcttcagctttatttacagtaagtggagtgaatgtgagagaggctgagtgcttaacacatcattgtgtatcgcttgaacagctgtgctaagtgtggtttatttttgttactaggtccggtgtcagaggatgagtcatcaccctcagaagaagaccacccgtctccccctgagctgtcaggcgaaacgcccctgcaagtgcacagacccaccccagtcagagctagtggcgagaggcgagcagctgttgacaaaattgaggacttgttacatgacatgggtggggatgaacctttggacctgagcttgaaacgccccaggaattaggcgcagctgcgcttagtcatgtgtaaataaagttgtacaataaaagtgtatgtgacgcatgcaaggtgtggtttatgactcatgggcggggcttagtcctatataagtgccaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatctttttgctgactgctctggcctgctagattctctgaatcttggtcaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtagccagcctgtacccagagcttagcaaggtgctgacatccatggccaggggagtgaagagggagaggagcgatgggggcaataccgggatgatgaccgagctgactgccagtctgatgaatcgcaagcgcccagagcgccttacctggtacgagcttcagcaggagtgcagggatgagataggcctgatgcaggataaatatggcctggagcagataaaaacccattggttgaacccagatgaggattgggaggaggccattaagaagtatgccaagatagccctgcgcccagattgcaagtacatggtgaccaagaccgtgaatatcagacatgcttgctacatctcggggaacggggcagaggtggtcatcgatacactggacaaggccgccttcaggtgttgcatgatgggaatgagagccggagtgatgaatatgaattccatgatcttcatgaacatgaagttcaatggagagaagtttaatggggtgctgttcatggccaacagtcacatgaccctgcatggctgcagtttctttggcttcaacaatatgtgtgcagaggtttggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacggcctctctgaagcataatatggtgaagggctgcacggatgagcgcatgtacaacatgctgacctgcgactcgggggtctgtcatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatatgatgagaccaagtccagggtgcgcgcttgcgagtgcgggggcagacataccaggatgcagccagtggccctggatgtgaccgaggagctgagaccagaccacctggtgatggcctgtaccgggaccgagtttagctccagtggggaggacacagattagaggtaggtttttgagtagtgggcgtggctaatgtgagtataaaggtgggtgtcttacgagggtcttttgcttttctgcagacatcatgaacgggaccggcggggctttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcactcgacagcaccgccgcagccgcggcagccgcagccgccatgacagcgacgagactggcctcgagctacatgcccagcagcggcagcagcccctccgtgcccagttccatcatcgccgaggagaaactgctggccctgctggccgagctggaagccctgagtcgccagctggccgccctgacccagcaggtgtccgatctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccggggatggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtggagtttggcctggatcttcaggttggcaatgttgccgcccagatcccgcctggggttcatgttgtgcaggaccaccaggacggtgtagcccgtgcacttggggaacttatcatgcaacttggaagggaatgcgtggaagaatttggagacgcctttgtgcccgcccaggttttccatgcactcatccatgatgatggcgatgggcccgtgggctgcggctttggcaaagacgtttctggggtcagagacatcataattatgctcctgggtgagatcatcataagacattttaatgaatttggggcggagggtgccagattgggggacgatggttccctcgggccccggggcgaagttcccctcacatatttgcatctcccaggctttcatctcggaggggggaatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccgaggaggcggtctccgcccagcgagagcagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggttgtctccgtcacggtgaaggggtgggccccgggttgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggagcgaaagcgtccgctccgcagtgggcgcagactgtctcgcactcgacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggagcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggttcccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgttggagagaagcttggcgatggatctcatggtctgatttttgtcacggtcggcgcgctccttggccgcgatgtttagctggacatactcgcgcgcgacgcacttccattcggggaagacggcggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaaagggggcaacacatcaagcagatgctcgtcaggggggtccgcatcgatggtgaagatgcccggacagagttccttgtcaaaatagtctatttttgaggatgcatcatccaaggccatctgccactcgcgggcggccagcgctcgctcgtaggggttgaggggcggaccccagggcatgggatgcgtgagggcggaggcatacatgccgcagatgtcatacacatagatgggctctgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttctcggatgatgtcataacccgcctctcctttcttctcccacagctcgcggttgagggcatactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgagtcagggcgaaggtgtccctgaccatgactttcaagaactggtacttgaagtccgagtcgtcgcagccgccgtgctcccagagctcgaaatcggtgcgcttctttgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcgggacattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtctcccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcacgcagttgggagctgtccatggtgtcgcggagatccaggtccgggggcagggttctgaggttgacctcgtagaggcgggtgagggcgtgcttgagatgcagatggtacttgatctccactggggagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgttcgacggtggcggcgaggtcattcgagatgcgacccatgagctgcgagaaggcgcccaggccgctctcgttccagacgcggctgtagaccacgtccccgtcggcgtcgcgcgctcgcatgaccacctgcgcgaggttgagctccacgtgccgcgtgaagacagcgtagttgcgcaggcgctggaagaggtagttgagggtggtggcgatgtgctcggtgacgaagaagtacatgatccagcggcgcaggggcatttcgctgatgtcgccgatggcctccagcctttccatggcctcgtagaagtccacggcgaagttgaaaaactgggcattgcgggccgagaccgtgagctcgtcttccaggagcctgatgagctcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgaacgcgtcgagatcgacaggatcggagaatctttcgaggaaagcgtctagccaatcgcagtcgcaaggtaagctcaaacacgtagcagccctgtggacgctgttagaattgcggttgctgatgatgtaattgaagtaggcgtttttaaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcattattggcggaggcggagtcttccatgcgggtgaccccgacgcccctgagcggctgcacgagcgccaggtcggcgacgacgcgttcggcgaggatggcctgttgcacgcgggtgagggtgtcctggaagtcgtccatgtcgacgaagcggtggtaggccccggtgttgatggtgtaggtgcagttggccatgagcgaccagttaacggtctgcaggccgggctgcacgacctcggagtacctgagccgcgagaaggcgcgcgagtcgaagacgtagtcgttgcaggtgcgcacgaggtattggtagccgactaggaagtgcggcggcggctggcggtagagcggccagcgctgggtggccggcgcgcccggggccaggtcctctagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgaggggtgtcgctagacttgaaagcggccgaaaaccctgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccgatttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcctgagcctggccgagaaagtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctaagcgacgacctgggcgtgtaccgcaacgaccgcatccacaaggccgtgagcacgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctaggctcgctggtggcgctgaacgccttcctggcgacgcagccggcgaacgtgccgcgcgggcaggacgattacaccaactttatcagcgcgctgcggctgatggtgaccgaggtgccccagagcgaggtgtatcagtcgggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggtcacctgctgacgctgtaccgcgaggccataggccaggcgcaggtggacgagcagaccttccaggagatcactagcgtaagccgcgcgctggggcagaacgacaccgacagtctgagggccaccctgaactttttgctgaccaatagacagcagaagatcccggcacagtacgcgctgtcggccgaggaggaaaggatcctgagatatgtgcagcagagcgtagggctgttcctgatgcaggagggtgccacccccagcgccgcgctggacatgaccgcgcgcaacatggaacctagcatgtacgccgccaaccggccgtttatcaataagctgatggactacctgcaccgcgcggcggccatgaacacggactactttacaaacgccatcctgaacccgcactggctcccgccgcctgggttctacacgggcgagtacgacatgcccgaccccaacgacgggttcctgtgggacgacgtggacagcgcggtgttctcgccgacttttcaaaagcgccaggaggcgccgccgagcgagggcgcggtggggaggagcccttttcctagcttagggagtttgcatagcttgccgggctcggtgaacagcggcagggtgagccggccgcgcttgctgggtgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggcgacggatgttttgaaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaaacatccagagaatgtagctaaagatgatttgagtcaggataagcttgagtatgagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccgggggtctacacctacgaggccttccacccggacgtggtgctgctgccgggctgcggggtggacttcaccgagagccgcctgagcaacctcctgggcattcgcaagaagcaacctttccaagagggcttcaggatcatgtatgaggatttagaagggggcaacatccccgcactccttgatgtggccaagtacttggaaagcaagaagaaggtagaggaagcaattaagaaggccgctgaaaccaatggaacccctagaggagacagtgatgttgcaagagaggtggaaaaggcagctcaaactcagcttgtcattgagcccatcaagcaagatgatagcaagagaagttacaacctcatcgagggaaccatggacacgctgtaccgcagctggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcatacaagcgcggccggacttccgccgccgccgtgcgcaccaccgtcgacgatgtcatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatttctagcatgaccagacccaggcgcggaaacgtgtactgggtgcgcgactccgtcacgggcgcgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcctccaccgctaccgcctccacttctaccgccgccacggctaccgagcctcccagaaggcgaagatggggcgccgccagccggctgatgcccaactacgtgttgcatccttccatcatcccgacgccgggctaccgcggcacccggtactacgccagccgccggcgcccagccgccaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggtggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaaactcaaagaccagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcggccgcggcccgacgcggaggagacgatcctgcaggtggacgagccgccctcgtacgaggaggccgttaaggccggcatgcccaccacgcgcatcatcgcgccgctggccacgggtgtaatgaaacccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagccccggtctggtgcagtttgcccgtgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctattcgggcacggcctacaacagcctggctcccaagagcgctcccaatcccagccagtgggatgcaaaggaaaaggaaggagttgcccaaacagaaaaaaatgttttaaaaacatttggtgttgccgctacaggtggttttaatattacagatcagggtctgttacttggaactgaggaaacagctgaaaacgttaaaaaggatatctatgcagagaaaactttccagcctgaacctcaagttggtgaagaaaactggcaggaaagtgaagccttttatggaggaagggctattaagaaagacaccaaaatgaagccatgctatggttcatttgccagacccactaatgaaaaaggaggacaggctaaatttaaaacactagatgggcaagttacaaaagatccagatattgactttgcttactttgacgtccctggcggaaaagctccaacaggcagtagtctgccggaagaatacaaagcagatataattttgtacacagaaaatgttaatctggaaacaccagatactcacatagtgtataaacctggcaaagaagatgacaattctgaaattaacttaacacaacagtccatgccaaacagacccaactacattggcttcagggacaactttgtaggtctcatgtactacaacagtactggcaacatgggtgtgctggctggtcaggcctctcagttgaatgctgtggtggacttgcaagacagaaacaccgagctgtcttaccagctcttgctagattctctgggtgacagaaccagatactttagcatgtggaactctgcggttgacagttatgatcccgatgtcaggatcattgaaaatcacggtgtggaagatgaacttccaaactactgcttcccattgaatggcactggaaccaattccacttaccaaggtgtaaaggttcaagatggtcaagatggggataaagaaactgagtgggaaaaagacgatgcaatttctagacaaaaccaaatctgcaagggcaatgtctacgccatggagatcaacctccaggccaacctgtggaagagttttctgtactcgaacgtggccctgtacctgcccgactcctacaagtacactccggccaacgtcacgctgcccaccaacaccaacacctacgagtacatgaacggccgcgtggtagccccctcactggtggacgcctacatcaacatcggcgcccgctggtcgctggatcccatggacaacgttaaccccttcaaccaccaccgcaacgcgggcctgcgctaccgctccatgcttctgggcaacggtcgctacgtgcccttccacatccaagtgccccaaaagttctttgccatcaagaacctgcttctgctccccggctcctacacctacgagtggaacttccgcaaggacgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccatcacgcaactgggccgccttccgcggctggagtttcaccaggctaaagaccaaggaaactccctccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctagcacccaccatgcgccaggggcagccctaccccgccaacttcccctacccgctcattggctctaccgccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctagccggcgacaagctggcctgtgccattgtcaacacggccggccgcgagaccggaggcgtgcactggctcgccttcggctggaacccgcgctcgcgcacctgctacatgttcgacccattcgggttctcggaccgccggctcaagcagatttacagcttcgagtacgaggccatgctgcgccgcagcgccctggcctcctcacccgaccggtgtctcagcctcgagcagtccacccagaccgtgcaggggcccgactctgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgatcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgcttgggagggccacgttgcggtactggaacttgggctgccacttgaactcggggatcaccagtttgggcactggggtctcggggaaggtctcgctccacatgcgccgactcatctgcagggcgcccagtatgtccggggcggagatcttgaaatcgcagttgggaccggtgctctgcgcgcgcgagttgcggtacacggggttgcagcactggaacaccatcagactggggtgcttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcattcccgcgccgcgctgcatattcgggtagagagccttgacaaaggccgagatctgcttgaaagcttgctgggccttggccccctcgctaaagaacaggccacagctcttcccgctgaactggttattcccgcacccggcatcctgcacgcagcagcgcgcgtcatggctggtcagttgcaccacgctccggccccagcggttctgggtcaccttggccttgctgggttgctccttcaacgcgcgctgcccgttctcgctggtcacatccatctccaccacgtggtccttgtggatcatcaccgtcccatgcagacacttgagctggccttccacctcggtgcagccgtggtcccacagggcgcatccggtgcactcccaattcttgtgcgcgattccgctgtggctgaagatgtaaccttgcaacatgcggcccatgatggtgctaaatgctttctgggtggtgaaggtcagttgcagaccgcgggcctcctcgttcatccaggtctggcacatcttttggaagatctcggtctgctcgggcatgagcttgtaggcatcgcgcaggccgctgtcgacgcggtagcgttccatcagcacgttcatggtatccatgcccttctcccatgacgagaccagaggcagactcagggggttgcgcacgttcaggacaccaggggtcgcgggctcgacgatgcgttttccgtccttgccttccttcaacagaaccggcggctggctgaatcccactcccacgatcacggcgtcttcctggggcatctcttcgtcggggtctaccttggtcacatgcttggtcttcctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacttgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacatgcgagcccaacccgcgtctcaacttctatcccgtctttgcggtccccgaggccctcgccacctatcacatctttttcaagaaccaaaagatccccgtctcctgtcgcgccaaccgcacccgcgccgacgcgctcctctctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggttatgcgtcgcatcatggatcagctcatcatgccccacatcgaggccctcgatgagacgcaagagcagcgccccgaggacgcccggcccgtggtcagcgacgagatgctcgctcgctggctcgggacccgcgacccccaggccctggagcagcggcgcaagctcatgctggccgtggtcctggtcaccctcgagctcgaatgcatgcgtcgcttcttcagcgaccccgagaccctgcgcaaggtcgaggagacgctgcactacactttcaggcacggtttcgtcaggcaggcctgcaagatctccaacgtggagctgaccaacctggtctcctgcctggggatccttcacgagaaccgcctgggacagaccgtgctccactctaccctgaagggcgaggcgcgtcgggactatgtccgcgactgcgtctttctctttctctgccacacatggcaagcagccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatctggaatgctgcccgccacctgcaacgctttcccctccgactttgtcccgctgagctaccgcgagtgtcccccgccgctgtggagccactgctacctcttgcagctggccaactacatctcctaccactcggacgtgatcgaggacgtgagcggcgaggggcttctcgagtgccactgccgctgcaacctgtgctccccgcaccgctcactagtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgctctggccgaagtccgcatgactaactcaggtgtccagctggctggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctgaactaagaacctactttggaatcccttgtcgtcatcctcgaaacaagaccgtcttctttaccaaccagaccaaggtccgtctgaactgtacaaccaacaggaagtaccttctctggactttccaagacacctcactcgctgttgtcaatacccgtgacaacgacggtgttttaatccccaacaacctcaccagtggacttactttctctaccaacaaaacaaagctcatccttcaccacccttttgtagagggaacctaccagtgccgacacggaccttgtgttcacaacttccatttggtgaaccttaccagcagcagcacagttgctcctgaaactaacctttcttctgatactaacaaacctcgtgtcggaggtgagctttgggttccatctctaacagagggtgggaattctattgaagtggttgggtatttgattttaggggtggtccttggtgggtgcatagcagtgctgtatcaacttccttgctgggtcgaaatcagggtatttatctgctgggtcagacattgtggggaggaaccatgaaggggctcttgctgattatcctttccctggtggggggtgtactgtcatgccacgaacagccacgatgtaacatcaccacaggcaatgagaggagtgtgatatgcacagtagtcatcaaatgcgagcataaatgtcctctcaacatcacattcaaaaaccgtaccatggggaatgcatgggtgggcgactgggaaccaggagatgagcagaactacacggtcactgtccatggtagcaatggaaatcacactttcggtttcaaattcatttttgaagtcatgtgtgatatcacactacatgtggctagacttcatggcttgtggccccctaccaaggagaacatggtgggtttttctttggcttttgtgatcatggcctgctttatgtcaggtctgctggtaggggctctagtgtggtttctgaagcgcaagcccaggtatggaaatgaggagaaggaaaaattgctataaatctttttctcttcgcagaaccatgaatactctgaccagtgtcgtgctgctctctcttcttgtggtttttagtcagggaaaaatagatagtgaagatgttattggtcattggggtaaaaatataacactagttggaccgacagaaaaacctattgaatggcatggaccaagagttcagctttgcgatggtccaaaaatcttacatacagaatttaatcacacctgtaatgaacagaatcttactttgatattcttgaacaacagttttaatggaaaatactatggtataagaaaggatgggtttggaatgaaacagtacaatcttaaggttattgctccaaaagcttccactcgtaaacctctttccccgcctaagcaaattgatgtcaaaatgggacaaaatgtaactctagttgggccagtagatactccagttaattggcatggaccaaaacatgaactatgcagaggaaatcagataatacatccagaagttaatcatacatgcaatgaacaaaacctcacattgctgtttgttaactacactttctggggagcatatcttggctttgacagatatggtactgacagagtgcattatgaggttacaataatagatggatttgaaaatgcagggcaacaaaaatatgatgagacaagtcagcacaagcctagcaataaagatagaccaagtccaaaagtaaaaaatcctcagaaaacaaaaaacacacacaagacaaacatgcagaacaaaaaggatattgagaaagattttcccagaggatctaatcaaactcttgtgggacctcctggttcaaaagttgactggtatgaaggtaaaaatggtgaccttgtaaaactctgtgatggaaagtctggtttaaaggtttcatgcaatgatcaaaacatcactttgattaatgtgaatgaaacctatgctggaacttattatggttctaacaatgacgaccatagacagtatagagtcactgtctatacaataccgcgtaataaaactgttaaaattcaacctcataccacaaaaggaaccacagtgggtgccacagttaatgaacagtttgctctgcaacaaggtaatgataaaaccaatcaagatgatgaacaaattccatcaactactgtggcaatcgtggtgggtgtgattgcgggcttcataactataatcattgtcattctgtgctacatctgctgccgcaagcgtcccaggtcatacaatcatatggtagacccactactcagcttctcttactgaaactcagtcactctcatttcagaaccatgaaggctttcacagcttgcgttctgactagcttagtcacactcattgcagctgcaggatatactcaaattagcatacctaggggtggtagcattacattaaatggtacttttagaaatactacatggacaagatatcacacaaatggttggaaaaaaatttgtgaatggaatgttacagcttataaatgtcacaataatggaagcattactattactgccacaaatattacttctggcagatacaaagctgacagttacaaaaaagaaattagaacttcattttttagaaataataagactacattcgaagattctggaaattatgaacagcagagattgactttatttaatctaacaataattgagccgccaactacgaaggcacccactaccactaaaccaaccacagttaggacaactagggaaacaaccacacagcctaccacagccagtacaactgttgagaccactactcacactacacagttagacactacagtacataatagtactgtgatgataaggtttttgttgagggaggaaagtactactgaacagacagaggctacctcaagtgccttcagcagcactgcaaatttaacttcgcttgcttcaataaatgagaccctcgtgccgatgaaacaggatcaacctaattactcaggtttggatatgcaaattactttcttaattgtctgtggggtctttattcttgcggttcttctttactttgtcttttgcaaagccagacaaaaatctcatagaacaatctacaggccagtgattggggaacctcagcccctccaagtggacggaggcttaaggaatcttctcttctcttttacagtatggtgatcagccatgattcctaggttcttcctatttaacatcctcttctgtctcttcaacatctgtgctgccttcgcggccgtctcgcacgcctcgcccgactgtctcgggcccttcccaacctacctcctctttgccctgctaacctgcacctgcgtctgcagcattgtctgcctggtcatcaccttcctgcagctcatcgactggtgctgcgcgcgctacaattacctacaccacagtcccgaatacagggacgagaacgtagccagaatcttaaggctcatctgaccatgcagactctgctcatactgctatccctcctataccctgcccttgctgatgattactctaagtgcaaattcgcggacatatggaatttcttagactgttatcaggagaaaatggatatgccttcctattacttggtgattgtggggatagtcatggtctgctcctgcactttctttgccatcatgatctacccctgttttgatcttggctggaactctgttgaggcattcacatacacactagaaagcagttcactagcctccacaccaccacccacaccgcctccccgcagaaatcagtttcccatgattcagtacttagaagagccccctccccggcccccttccactgttagctactttcacataaccggcggcgatgactgacaaccacctggacctcgagatggacggccaggcatccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgagaccaacggctgcatccactgctcctgcgaaagccccgagtgcatctactccctgctcaagaccctttgcggactacgcgacctcctccccatgaactgatgttgattaaaagcccaaaaaccaatcagccccttcccccatttccccattcccaattactcacaagaataaatcattggaactaatcattcaataaagatcacttacttgaaatctgaaagtatgtctctggtgtagttgttcagcaacacctcggtaccctcctcccagctctggtactccagtccccggcgggcggcaaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcactcaaattggctgatccaatagccatcaccaatggggatgtctcactcaaggtgggaggtggactcactgtggaaaaagagtctggaaagctaagtgctgaccctaagactcccttgcaagttgcaactgacaacaaattggaacttgcttataatgcgccatttaaagttgaaaatgacaagctatcgcttgatgtaggccatggattaaaagtgataggtaatgaaatatcaagtttgcctggattagtgaataagcttgttgttttaactggtaagggaattggcactgaagagttaaaagaacaaaacagcgataaactaataggagttggaattagtgtaagagcaagaggaggtttgacatttgacaatgacggctacttagtagcttggaatccaaagtatgatacacgcacactttggacaactccagacacatctcctaattgcaagatggtcacaaaaaaggactcaaaacttacactgacacttacaaagtgcggaagtcaaattttaggaaatgtatctttacttgctgtctctggaaagtatctaaacatgacaaaggacgaaacaggagttaagataattttactatttgacaaaaatggagttcttatggagcaatcatcgcttgataaagaatattggaactatagaaatgacaataatgtcgttggaactccttatgaaaatgctgttggatttatgccaaacttagtggcatatcctaaaccatcaagtgcagatgcaaagaactattcaagaagcaagataataagtaatgtatacttaaagggtcttatatatcaaccagtaattataattgccagttttaatcaggaaaccactaatggttgtgtctattctatttcatttgatttcacctgttcaaaggattacactggccaacaatttgatgttacctcattcactttctcctatatcgcccaagaatgaaagaccaataaacgtgtttttcatttgaaaattttcatgtatctttattgatttttacaccagcacgggtagtcagtctcccaccaccagcccatttcacagtgtaaacaattctctcagcacgggtagccttaaataggggaatgttctgattagtgcgggaactgaacttggggtctataatccacacagtttcctggcgagccaaacgggggtcggtgattgagatgaagccgtcctctgaaaagtcatccaagcgggcctcgcagtccaaggtcacagtctggtggaatgagaagaacgcacagattcatactcggaaaacaggatgggtctgtgcctctccatcagcgccctcaacagtctttgccgccggggctcggtgcggctgctgcagatgggatcgggatcgcaagtctctctgactatgatccccacagccttcagcatcagtctcctggtgcgtcgggcacagcaccgcatcctgatctcgctcatgttctcacagtaagtgcagcacataatcaccatattattcaacagcccataattcagggtgctccagccaaagctcatgttggggatgatggaacccacgtgaccatcataccagatgcggcagtatatcaggtgcctgcccctcatgaaca

SEQ ID NO: 1432 - DNA, 32767 bp, Human mastadenovirus D
catcatcaataatataccccacaaagtaaacaaaagttaatatgcaaatgagcttttgaatttagggcggggccgacgctgattggacgagagaagacgatgcaaatgacgtcacgacgcacggctaacggtcgccgcggaggcgtggcctagcccggaagcaagtcgcggggctgatgacgtataaaaaagcggactttagacccggaaacggccgattttcccgcggccaagcccggatatgaggtaattctgggcggatgcaagtgaaattaggtcattttggcgcgaaaactgaatgaggaagtgaaaagtgaaaaataccgggcccgcccagggcggaatatttaccgagggccgagagactttgaccgattacgtgggggtttcgattacggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagaccgagaaaaatgagacacctgcgccttctaccttcaactgtgcccggggacctggctgtgattatgctggaggactttgtgaatacagttctggaggacgaactgcaaccagagccatttgagctgggacctacacttcaggacctctatgatctggaggtagatgcccatgatgacgaccctaacgaagaggctgtgaatttaatatttccagaatctatgattcttcaggctgacatagccagtgaagccatagttactcctctacatactccaactctgccgcctatacctgaattggaagaggaggatgagatagacctccggtgctacgaggaaggttttcctcccagcgattcagaggacgaacagggtgagcgagagatggctattctatcggactttgcttgtgtgattgtggaggagcaagatgtgattgaaaaatctactgagccagtacaaggctgtaggaactgccagtaccaccgggataagtccggagatgtgaacgcctcctgcgctttgtgctatatgaaacagactttcagctttatttacagtaagtggagtgaatgtgagagaggctgagtgcttaacacataactgtaatgcttgaacagctgtgctaagtgtggtttattttgttactaggtccggtgtcagaggatgagtcatcaccctcagaagaagaccgcccgtctccccctgagctgtcaggcgaaacgcccctgcaagtgttcagacccaccccagtcagacccagtggcgagaggcgagcggctgttgacaaaattgaggacttgttgcaggacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataacgaggaatttgaaaatctttttgctgactgctctggcctgctagattctctgaatcttggccaccagtcccttttccaggaaagggtacttcacagccttgatttttccagcccagggcgcactacagccggggttgcttttgtggtttttctggttgacaaatggagccaggacacccaactgagcaggggatacatcctggacttcgcagccatgcacctgtggaggtcctggatcaggcagcggggacagagaatcttgaactactggcttctacagccagcagctccaggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtgaagagggagaggagtgatgggggcaataccgggatgatgaccgagctgacggccagcttgatgaatcgcaagcgtccagagcgcattacctggcacgagctacagcaggagtgcagggatgagataggcctgatgcaggataaatatggcctggagcagataaaaacccactggttgaacccagatgaggattgggaggaggccattaagaagtatgccaagatagccctgcgcccagattgcaagtacaggatcaccaagacggtgaatattagacatgcctgctacatctcagggaacggggcagaggtgatgatcgataccctggacaagtcagctttcaggtgttgcatgatgggaatgagagccggagtgatgaatatgaattccatgatcttcatgaacatgaagttcaatggagagaagtttaatggggtgctgttcatggccaacagccacatgaccgtacatggctgcagcttcttcggtttcaacaacatgtgtgcagaggtctggggagctgctaagatcaggggctgtaagttttatggctgctggatgggagtggtcggaagacccaagagcgagatgtctgtgaagcagtgtgtgtttgagaagtgctacctgggggtgtctacagagggcaatgctagagtgagacattgctcttccctggagacgggctgcttctgcctggtgaagggcacagcttcgatcaagcataatgtggtgaaaggctgcacggatgagcgcatgtacaacatgctgacctgcgactcaggggtctgtcatatcctgaagaacatccatgtgaccgcccactccagaaagaagtggccagtgtttgagaataacctgctaatcaagtgccatatgcacctgggagccagaaggggcaccttccagccgtaccagtgcaactttagccagaccaagctgctgttggagaacgatgccttctctagggtgaacctgaacggcatctttgacatggatgtctcggtgtacaagatcctgagatacgatgagaccaggtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaatgtgagtataaaggtgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggagctcgtcgctcgacagcaccgccgcagccgcggcagccgcagccgccatgacagcgacgagactggcctcgagctacatgcccagcagcggtagcagcccatctgtgcccagttccatcatcgccgaggagaaactgctggccctgctggccgagctggaagccctgagccgccagctggccgccctgacccagcaggtgtccgagctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcaatgttgccgcccagatcacgccgtgggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagacacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgataaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccgaggaggcggtccccgcccagcgagaggagctcttgcagggaagcaaagtttttcaggggctttagtccgtcggccatgggcatcttggcgagggtctgcgagaggagctccaggcggtcccagagctcggtgacgtgctctacggcatctctatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggcccctggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggtgcgagaaagaccgattcgggggcgaaagcatccgctccgcagtgggcgcagacggtctcgcactcgacgagccaggtgagctcggggtgatcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacgaaggcgcgcgtccacgccaagacaaaggaggctacgtgcgaggggtagcggtcgttgtccaccagggggtccaccttttccaccgtgtgcagacacatgtccccctcctccgcatccaagaaggtgattggcttgtaggtgtaggccacgtgacccggggtccccgacgggggggtataaaagggggcgggtctgtgctcgtcctcactctcttccgcgtcgctgtccacgagcgccagctgttggggtaggtattccctctcgagagcgggcataacctcggcactcaggttgtcagtttctagaaacgaggaggatttgatgttggcttgccctgccgcgatgctttttaggagactttcatccatctggtcagaaaagactatttttttattgtcaagcttggtggcaaaggagccatagagggcgttggagagaagcttagcgatggatctcatggtctgatttttgtcacggtcggcgcgctcctttgccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaaagggggcagcacatcaaggagatgctcgtcagggggatccgcatcgatggtgaagatgcccggacagagttccttgtcaaaatagtctatttttgaggatgcatcatccaaggccatctgccactcgcgggcggccagcgctcgctcgtaggggttgagcggcggaccccagggcatgggatgcgtaagggcggaggcgtacatgccgcagatgtcatagacatagatgggctccgagaggatgccgatgtaggtgggataacagcgccccccgcggatgctggcgcgcacatagtcatacaactcgtgcgagggggccaaaaaggcggggccgagattggtgcgctggggctgctcggcacggaagacgatctggcgaaagatggcatgcgagttggaggagatggtgggccgttggaagatgttaaagtgggcgtggggcaggcggaccgagtcgcggatgaagtgcgcgtaggagtcttgcagcttggcgacgagctcggcggtgacgaggacgtccatggcgcagtagtcgagcgtttcgcggatgatgtcataacccgcctctcctttcttctcccacagctcgcggttgagggcatactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgtgtcagggcgaaggtgtccctgaccatgactttcaagaactggtacttgaagtccgagtcgtcgcagccgccgtgctcccagagctcgaaatcggtgcgctttttcgagagggggttaggcagagcgaaagtgacgtcattgaagagaatcttgcctgcccgcggcatgaaattgcgggtgatgcggaaagggccaggcacggaggctcggttgttgatgacctgggcggcgaggacgatctcgtcgaagccgttgatgttgtgcccgacgatgtagagttccatgaatcgcgggcggcctttgatgtgcggcagctttttgagctcttcgtaggtgaggtcctcggggcattgcaggccgtgctgctcgagcgcccactcttggagatggggattggcgcgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtgacaaagagccgctccgtgcgaggatgagagccgatggggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcgcagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcgctttagaagcggtgtcgcggacgcgctcccggcggcagcggcggttccggccccgcgggcaggggcggcagaggcacgtctgcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgcctcggcccgcgcgctcgacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcgtcgcaggggcatctcgctgatgtcgccgatggcctccaacctttccatggcctcgtagaagtccacggcgaagttgaaaaactgggcgttgcgggccgagaccgtgagctcgtcttccaggagcctgatgagctcggcgatggtggcgcgcacctcgcgctcgaaatccccgggagcctcctcctcttcctcttcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcagacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctctatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtagcccacaaggcagtgcggcggcggctggcggtagaggggccagcgctgggtggccggcgcgcccggggccaggtcctcgagcatgaggcggtggtagccgtagaggtagcgtgacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgccggccgcgcggggtcgctagacttgaaagcggccgaaaaccccgccgggtagtggctcgcgcccgtagtctggagaagcattgccagggttgagtcgcggcagaacccggttcgcggacggccgcggcgagcgggacttggtctccccgcctataagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctgtaagccagccacagcagacagaaatggacttggaagagggcgaagggctggcgagactgggggcgccgtccccggagcgacacccccgcgtgcagctgcagaaggacgtgcgcccggcgtacgtgcccgcgcagaacctgttcagggaccgcagcggggaggagcccgaggagatgcgcgactgccggtttcgggcgggcagggagctgcgcgagggtctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggcccttggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgttgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcactggtagggggcgccaccggcggtgaggagtcctacttcgacatgggggcggacctgcattggcagccgagccggcgcgccttggaggccgcctacggtccagaggacttggatgaggatgaggaagaggaggaggatgcacccgttgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcctgcagacggtgaacctgagccaggctttcaagaatctgcgcgggctgtggggcgtgcaggcgcccgtgggcgacaggtcgacggtgagcagtttgctgacgcccaactcgcggctgctgctgctgctgatcgcgcccttcaccgacagcggcagcgtgaaccgcaactcgtacctgggccacctgctgacgctgtatagggaggccataggccaggcgcaggtggacgagcagaccttccaggagatcacgagcgtaagccgcgcgctggggcagaacgacaccgacagtctgagggccaccctgaactttttgctgaccaatagacagcagaagatcccgccgcagtacgcactgtcggccgaggaggaaaggatcttgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacctgcaccgcgcggcggccatgaactcggactactttaccaatgccattctgaacccgcactggctcccgccgccggggttctacacgggcgagtacgacatgcccgaccccaacgacgggttcctgtgggacgacgtggacagcgcggtgttctcgcccgcctttcaaaagcgacaggaagcggtgcgcacgcctagcgagggcgctgtgggacggagcccctttcctagcttggggagtttgcatagcctgccgggctcggtgaacagtggcagggtgagccgaccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggtggggccaacccgttcgcgcatctgcagcccagactggggcgacggatgttttaaatgcaaaataaaactcaccaaggccatagcgtgcgttctcttccttgttagagatgaggcgcgcggtggtgtctcctcctccctcgtacgagagcgtgatggcgcaggcgaccctggaggttccgtttgtgcctccgcggtatatggcgcctacggagggcagaaacagcattcgttactcggagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcccggtggggcggtgatctgaagaccattctgcacaccaacatgcccaatgtgaacgagtacatgttcaccagcaagtttaaggcgcgggtgatggtggctagaaaaaaggcggaaggggctgatgcaaatgatagaagcaaggatatcttagagtatcagtggtttgagtttaccctgcccgagggcaacttttccgagaccatgaccatagacctgatgaacaacgccatcttggaaaactacttgcaagtggggcggcaaaatggcgtgctggagagtgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaaccttctgggcattcgcaagaagcaacctttccaagagggcttcagaatcatgtatgaggatctagaagggggcaacatacccgctcttctggataccaaaaaatatctggatagcaagaaagaaattgaagaagctgctaaaaatgcagccactgcaaatgatgcgcccaggggagatacttttgtcaatgaagctcaagagaaggcagctcagaagcagctagtgatcgagcccattgaaaaggatgacagcaacagaagttataatctcatacctggaaccatggacaccctgtaccgaagctggtacctgtcctatacctacggggaccccgagaagggggtgcagtcgtggacactgctcaccaccccggacgtcacctgcggcgcggagcaagtctactggtcgctgccggacctcatgcaagacccggtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctctccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgccaccgccgtgcgcaccaccgtcgacgacgtcatcgactcggtggtcgccgacgcgcgcaactacacccccgccccctccaccgtggacgcggtcatcgacagcgtggtagccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgccgccgccgcacccacccccgcaggcaggactcgcagacgagcggccgccgccgccgccgcggccatctctagcatgaccagacccagacgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggatgaaacgtagttatgacgaggtgtacggcgacgacgacatcctggaccaggcggcggagcgggcgggcgagttcgcctacgggaagcggtctcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgaaaacatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggcttccagcctccaccgctaccgtctccacttctaccgccgccacggctaccgagcctcccaggaggcgaagatggggcgccgccagccggctgatgccaaactacgtgttgcatccttccattatcccgacgccgggctaccgcggcacccggtattacaccagccgcaggcgcccagccaccaagcgccgccgccgcaccacccgccgccgtctggccccagcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacggcctggcctcgggcattaacggggtggtggacatcgcgaaccaggccgtgcagcgcgagataaacagccgtctggacccgcgcccgcccgccgccacggtggtggagatggaagatgcaagcgcgcatcctccgcccaagggcgagaagcggccgcggcccgacgcggaggagacgaccctgcaggtggacgagccgccctcgtacgaggaggccgtcaaggccggcatgcccaccacgcgcatcatcgcgccgctggccacgggtgtaatgaaacccgccaccctagacctgcctccaccacctacgcccgctccaccgaaggcagctccggtcgtgcagccccctccggtggcgaccgccgtgcgccgcgtccccgcccgccgccaggcccagaactggcagagcacgctgcacagtatcgtgggcctgggagtgaaaagtctgaagcgccgccgatgcttttgagagagaaaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttagaaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacggcttacaacagcctggcacccaagggcgcccccaatcccagtcagtggactaccaaagaaaagcagaccggagtaaatgcaggagacaaagaagttacaaagacatttggacttgccgccatgggaggcagtaatatttctaaggacggtttgcagattggaactgacacaacagcagatgctgtaaaaccaatatatgcagacaaaacttaccagccagaacctcaagtgggagaagaaaactggcaggataatgatgaatattatggcggcagggctcttaaaaaagatactaaaatgaagccatgctatggttcctttgctaaacccacaaacaaggaaggtggccaggctaaattgaaagaaacacccaatggtgctgatcctcaatatgatgtggacatggccttcttcgactcaaccactataaacattccagatgtagtgttatacactgaaaatgtagatttggaaactccagatacacatgtggtgtacaaaccaggcaaagaggatgagagttctgaagctaacttaactcagcagtccatgccaaacagaccaaactacattggcttcagagacaactttgtggggcttatgtattacaacagcactggcaacatgggtgtgctggctggtcaggcttcccaattgaatgctgtggtcgacttgcaagacagaaacacagagctgtcttaccagcttttgctagattctctgggtgacagaaccagatactttagcatgtggaactctgcggtggacagttatgatcccgatgttaggatcattgagaaccacggtgttgaagatgaacttcctaactattgcttccccttggacggtgttcaaactaattcagcctaccaaggtgttaaactaaaggctaatcaagcaggaggtggagctaatggagactgggaaaaggatgataccatttcagcccataatcaaattggaaagggcaacatctttgccatggagatcaacctccaggccaacctgtggaagagttttctgtactcgaacgtggcgctgtacctgcccgactccttcaagtacactccggccaacgtcactctgcccaccaacaccaacacctacgagtacatgaacggccgcgtggtggccccctcgctggtggacgcttacatcaacatcggcgcccgctggtcgctggaccccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgcttccgggctcctacacctacgagtggaacttccgcaaggatgtcaacatgatcctgcagagttccctcggcaacgacctgcgcgtcgacggcgcctccgtccgcttcgacagcgtcaacctctacgccaccttcttccccatggcgcacaacaccgcctccactctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccttccctcggctcgggtttcgacccctactttgtctactcgggctccatcccatacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcacccaccatgcgtcaggggcagccctaccccgccaacttcccctacccgctcatcggccagacggccgtgccctccgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacacccttctccgccggcaacgccaccacataagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgcgcttgcctcctcgcccgaccgctgtctcagcctcgaacagtccacccagaccgtgcaggggcccgactccgccgcctgcggacttttctgttgcatgttcttgcatgctttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccattccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagcttgggtacgggaatctcggggaaggtctcgctccacatgcgccggctcatctgcagggcgcccagcatgtcaggcgcggagatcttgaaatcgcagttggggccggtgctctgcgcgcgcgagttgcggtacacgggattgcagcactggaacaccatcagactggggtagttgacgctggccagcacgctcttgtcgctgatctgatccttgtccaggtcctcggcgttgctcaggccgaacggggtcatcttgcacagctggcggcccaggaagggcacgctgtgaggcttgtgattacactcgcagtgcacgggcatcagcatcatccccgcgccgcgctgcatattcgggtagagggccttgacgaaggccgtgatctgcttgaaagcttgctgggccttggctccctcgctgaagaacagcccgcagcttttcccgctgaactggttattcccacacccggcatcatgcacacagcagcgcgcgtcatggctggtcagttgcaccacgcttcggccccagcggttctgggtcaccttggccttgctgggctgttccttcaacgcgcgctgcccgttctcgctggtcacatccatctccaccacgtggtccttgtggatcatcactgtcccgtgcagacacttcagctggccttccacctcggtgcagccgtggtcccacagggcgctgccggtgcactcccagttcttatgcgcgataccgctgtggctgaagatgtaaccttgcaacaggcggcccatgatggtgctaaaggttttctgggtggtgaaggtcagttgcatcccgcgggcctcctcgttcatccaggtctggcacatcttctggaagatctcggtctgctcgggcatgagcttgtaagcatcgcgcagaccgctgtcgacgcggtaacgttccattagcacgttcatggcatccatgcccttctcccaggacgagactagaggcagactcagggggttgcgcacgttcaggacaccgggggtcgcgggctcgacgatgcgttttccgtccttgccttccttcaacagaaccggcggctggctgaatcccactcccacgatcacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgctgaaccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggaaaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtctggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaagctcatgctggccgtggtcctggtcaccctcgagctcgaatgcatgcgccgcttcttcaccgaccccgagaccctgcgcaaagtcgaggagaccctgcactacactttcagacacggcttcgtcaggcaggcctgcaagatctccaacgtggagctgaccaacctggtctcctgcctggggatccttcacgagaaccgcctggggcagaccgtgctccactctaccctgaagggcgaggcgcgtcgggactatgtccgcgactgcgtctttctctttctctgccacacatggcaagcagccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatctgggatgctgcccgccacctgcaacgctttcccctccgactttgtcccgctgagctaccgcgagtgtcccccgccgctgtggagccactgctacctcttgcagctggccaactacatcgcctatcactcggatgtgatcgaggacgtgagcggcgaggggctgctcgagtgccactgccgctgcaacctgtgctccccgcaccgctccctggtctgcaacccccagctccttagcgaaacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctctttcaccgcggggtgaacatcccccgcaacgtgttgcattactaccgtcaccttcacagctaagaaaaagcaagtaagaggagtcgccggaggaggaggaggcctgaggatcgcggcgaacgagccctcgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctgaactaagaacctactttggaatcccttgtcgtcatcctcgaaacaagaccgtcttctttaccaaccagaccaaggttcgtctgaactgtacaaccaacaggaagtaccttctctggactttccaaaacacctcactcgctgttgtcaatacccgtgacgacgacggtgttttaatccccaacaacctcactagtggacttacttacagtaccagaaaaactaagctcgtcctccacaaaccttttgtagagggaacctaccagtgccgacacggaccttgtgttcacacattccacttggtgaaccttaccagcagcagcacagttgctcctgaaacaactaacctttcttctgatactaacaaacctcgtgtcggaggtgagctttgggttccatctctaacagagggtgggagttctattgaagtggttgggtatttgattttaggggtggtactgggtgggtgcatagcagtgctgtatcaacttccttgctgggtcgaaatcagggtatttatctgctgggtcagacattgtggggaggaaccatgaaggggctcttgctgattatcctttccctggtggggggtgtactgtcatgccacgaacagccacgatgtaacatcaccacaggcaatgagagaagcgaatgctctgtagtcatcaaatgtgagcacaaatgttctctcaacattacattcaagaataagactatgggaaatgtctgggtgggattctggcaaccaggagatgagcagaactacacggtcactgtccatggtagcgatggaaatcacagtttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctctagtgtggttcctgaaacgcaagcccaggtacggaaatgaggagaaggaaaaattgctataaattctttttctcttcgcagaaccatgaatactttgaccagtgtcgtgctgctctctcttcttgtggtttttagtcagggaaaaatagatagtgaagatattattggtcattggggtaaaaatataacactagttggaccgacagaaaaacctattgaatggcatggaccaagagttcagctttgcgatggtccaaaaatcttacatccagaatttaatcacacctgtaatgaacagaatctcactctgatattcttgaacaacacttttaatgggaggtactatggtattattgattaatgtgaatgaaacctatgctggaacttattatggttctaacaatgacgaccatagacagtatagagtcactgtctatacaataccgcgtaataaaactgttaaaattcaacctcataccacaaaaggaaccacagggggtgccacagttaatgaacagtttgctctgcaacaaggtaatgataaaaccaatcaagatgatgaacaaattccatcaactactgtggcaatcgtggtgggtgtgattgcgggcttcataactataatcattgtcattctgtgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctggttatattcaagttaatgtgactagaggtgggaacattacattgaatggaccactacaaaatactacatggctaagataccatctaaatggttggcaacatatctgtacatggtctggtccgtcatataagtgccatactaataatggaagcattacaatttttgctattaacatcacttctggaacttataaagctgaaggatataaaaaagaggttaggactttctcatctacaaatcaaaaacatacaattgaagattctggtgattatgaagaacataaaatacttttatataatttaacaataattgaactgccgaccactaaagcacccacgacagttaggacaactagggaaacaaccacacagcctactacaaagccaactaccagtccaacaacacagcctactacagttagtacaactatggaggacactactcacactacagtacagaatagtactgtgttggttaggtttttgttgagggaggaaagtactactgaacaaacagaggctacctcaagtgccttcagcagcactgcaaatttaacttcgcttgcttcaataaatgagaccctcgtgccgatgaaacaggatcaacctaattactcaggtttggatatgcaaattactttcttaattgtctgtggggtctttattcttgtggttcttctttactttgtcttttgcaaagccagacaaaaagctcatagaacaatctacaggccagtgatcggggaaccccagccactccaagtggatggaggcttaaggaatcttcttttctcttttacagtatggtgatcagccatgattcctaggtttttcctatttaacatccttttctgtctcttcaacatctgcgctgcatttgcggccgtctcgcacgcctcgcccgactgtctcgggcccttcccaacctacctcctctttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatatgaccatgcagactctgctcatactgctatccctcctatcccctgcccttgctgctgatgattactctaagtgcaaatttgtggaactatggaatttcttagactgctatgatgctaaaattgatatgccttcctattacttggtaattgtgggaatagtcatggtctgctcctgcactttctttgccatcatgatctacccctgttttgatctcggctggaactctgttgaggcattcacatacacactagaaaacagttcactagcctccacgccaccacccacaccgcctccccgcagaaatcagttccccctgattcagtacttagaagagccccctccccggcccccttccactgttagctactttcacataaccggcggcgatgactgaccaccacctggaccttgagatggacggccaggcctccgagcagcgcatcctgcaactgcgcgtccgtcagcagcaggagcgggccgccaaggagctactcgatgccatcaatatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctcctcaagaccctttgcggacttcgcgacctcctccccatgaactgattgattaaagcccaaaaaccaatcaaaccccattccccaataccccaaataaacaatcattggaaataatcattcaataaagatcacttacttgaaatctgaaagtatgtctctggtgtagttgttcagcagcacctcggtcccctcctcccagctctggtactccagtccccggcgggcggcaaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcctccctttgtctcctccgatggattccaaaacttccccccaggggtcctgtcactcaaactggctgacccaatcgccatcgtcaacgggaatgtctcactcaaggtgggaggggggctcaccttgcaagaaggaactggggacctaaaggtgaacgctaagtccccattgcaagttgcaactaataaacagttggagattgcacttgctaaaccatttgaggaaaaggatggcaaacttgctttaaaaattggccatggattagccgttgtggatgaaaatcatactcacttacaatcactaataggtacacttgttattttaactggcaagggaattggtacaggtagtgctgaaagtggaggaactatagatgtaagactcggaagtggaggtggtttgtcatttgataaagacggaaacctagttgcttggaacaaagacaatgataggcgaactctttggaccacaccagatccttctccaaattgcaacattgaccaagaaaaggactctaaactaacattggttcttacaaaatgtggaagtcagatactggctaatatgtctttgcttgtagtcaaaggaaaattttgcattataaataataaggttaatgcaactgatgattacaaaaagtttagtatcaagctgctatttgatgccaagggacgtttattggaaggatctagtttagataaagcttattggaactatagaagcgttaataacaacataggtacagcttatgaagaagctgttggttttatgccaaacacaacagcatacccaaaactgcctaatcctccaacttcatctaccactcctatagaaaaaagccggtcaaaaaacaaatacgttagtaatctctaccttggtggacaagctggaaacccagtggctacaactattagttttaatgaagaaattgatgatacatgtgcttattctatcagatttgattttgcttggaataagacatatgaaaatgtgcagtttgattcctcttttttaactttctcatatattgctcaagaatgaaagaccaataaacgtttttcatttgaaattttcatgtatctttattgatttttacaccagcacgggtagtcagcctcccaccaccagcccatttcacagtgtaaacaattctctcagcacgggtggccttaaataggggaatattattattggaacgggaactagatttagtgtctataatccacacagtttcctggcgagccaaacgggggtcggtgattgagatgaagccgtcctctgagaagtcatccaagcgggcctcacagtccaaggtcacagtctggtggaacgagaagaacgcacagattcatactcggaaaacaggatgggtctgtgcctctccatcagcgccctcaacaatctttgccgccggggctcggtgcggctgctgcagatgggatcgggatcgcaagtctctctgactatgatccccacagccttcagcatcagtctcctggtgcgacgggcacagcaccgcatcctgatctctgccatgttctcacagtaagtgcagcacataatcaccatgttattcagcagcccataattcagggtgctccagccaaaactcatgttggggatgatggaacccacgtgaccatcgtaccagatgcggcagtatatcaggtgcctgcccctcatgaacacactgcccatatacatgatctctttgggcatgtctctgttcacaatctgacggtaccatgggaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcagggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagtgaagccctggtctcctcatcagatcgtggtaaacgggccctgcgatatggatgatggcgcagcaagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctc

SEQ ID NO: 1433 - DNA, 32767 bp, Human adenovirus 71
catcatcaataatataccccacaaagtaaacaaaagttaatatgcaaatgagcttttgaatttggggcgtggccgacgctgattggctgttgcgacgacggttactgacgtcatgacgcacggcgtcaacggtcgccgcggaggcgtggcctagcccggaagcaagtcgcggagctgatgacgtataaaaaagcggactttagacccggaaacggccgattttcccgcgaccacgcccggatatgaggtaattctgggcggatgcaagtgaaattaggtcattttggcgcgaaaactgaatgaggaagtgaaaagtgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtctgagaaaaatgagacacctgcgcctcctgcctggaactgtgcctatggacatggctgtgcttttactggatgactttgtgaatacagtattggaggacgaactgcatccaagtccgttcgagctgggacccacacttcaggacctttatgatctggaggtagatgcccatgatgacgacccgaacgaagaggctgtgaatttaatatttccagaatctatgattcttcaggctgacatagccaacgaatctatacctactccacttcatacaccgactctaccacccatacctgaattggaagaggaggacgaactagacctccggtgttatgaggaaggttttcctcccagcgattcagaggacgaacggggtgagcagagtatggctataatctcagactatgcttgtgtggttgtggaagagcattttgtgttggacaatcctgaggtgccagggcaaggctgtagatcctgccaatatcaccgggatcagaccggagacccaaatgtttcctgcgctctgtgttacatgaaaatgagcttcagctttatttacagtaagtggagtgaatgtgagagaggctgagtgcttaacacataactgtaatgcttgaacagctgtgctaagtgtggtttatttttgttactaggtccggtgtcagaggatgagtcatcaccctcagaagaagaccacccgtctccccctgagctgtcaggcgaaacgcccctgcaagtgcacagacccaccccagtcagacccagtggcgagaggcgagcggctgttgacaaaattgaggacttgttgcaggacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcactcgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataacgaggaatttgaaaatctttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggaggtcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtgaagagggagaggagcgatgggggcaataccgggatgatgaccgagctgacggccagcctgatgaatcgcaagcgtccagagcgcattacctggcacgagctacagatggagtgcagggatgaggtgggcctgatgcaggataaatatggcctggagcagataaaaacccattggttgaacccagatgaggattgggaggaggccattaagaaatatgccaagatagccctgcgtccagattgcaagtacagggtgaccaagacggtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcaatttcttcggcttcaacaatatgtgcgcagaggtctggggcgccgctaagatcaggggatgtaagttttatggctgctggatgggcgtggtcggaagacccaagagcgagatgtctgtgaagcagtgtgtgtttgagaaatgctacctggcagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggcgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagacccgaccacctggtgatggcctgtaccgggaccgagtttagctccagtggggaggacacagattagaggtaggtttttgagtagtgggcgtggctaatgtgagtataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggagctcgtcgctcgacagcaccgccgcagccgcggcagcagcagccgccatgacagcgacgagactggcctcgagctacatgcccagcagcagcagtagcccctctgtgcccagttccatcatcgccgaggagaaactgctggccctgctggccgagctggaagccctgagccgccagctggccgccctgacccagcaggtgtccgagctccgcgagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcttcgtgctctggggtcgtgttgtagatgatccagtcatagcaggggcgctgggcgtggtgctggatgatgtctttgaggaggagactgatggccacggggagccccttggtgtaggtgttggcgaagcggttgagctgggagggatgcatgcggggggagatgatgtgcagtttggcctggatcttgaggttggcgatgttgccgcccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcataattatgctcctgggtgagatcatcataagacattttaatgaatttggggcggagggtgccagattgggggacgatggttccctcgggccccggggcgaagtttccctcacagatctgcatctcccaggctttcatctcggagggggggatcatgtccacctgcggggcaatgaaaaaaacggtttccggggcgggggtgatgagctgcgaggagagcaggtttctcaacagctgggacttgccgcacccggtcggaccgtagatgaccccgatgacgggttgcaggtggtagttcaaggacatgcagctgccgtcgtcccggaggaggggggccacctcgttgagcatgtctctgacttggaggttttcccggacgagctcgccaaggaggcggtccccgcccagcgagagcagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctggtagttgagggcctcggcggcgtggcccttggctcggagcttgcccttggaagagcgcccgcaggagggacagaggagggactgcagggcgtagagctttggcgcaagaaagacggactcgggggcgaaagcgtccgctccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgctcggtgacaaacaagctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcaagcacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttaagctggacatactcgcgcgcgacacacttccattcgggaaagacggtggtgcgctcgtcgggcacgatcctaacgcgccagccacggttatgcagggtgaccaggtccacgctggtggccacctcgccgcgcaggggctcgttggtccagcagagtcgcccgcccttgcgcgagcagaacgggggcagcacatcaagcagatgctcgtcaggggggtccgcatcgatggtgaagatgcctggacagagttccttgtcaaaataatcgatttttgaggatgcatcatccaaggccatctgccacttgcgggcggccagtgctcgctcgtaggggttgaggggcggaccccagggcatgggatgagtgagggcggaggcgtacatgccgcagatgtcgtagacatagatgggctccgagaggatgccgatgtaggtgggataacagcgccccccgcggatgctggcgcgcacatagtcatacaactcgtgcgagggggccaagaaggcggggccgagattggtgcgctggggctgctcggcgcggaagacgatctggcgaaagatggcgtgcgagttggaggagatggtgggccgttggaagatattaaagtgggcgtgcggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaaatggttcacggccttgtagggacagcaacccttctccacggggagggcgtaagcttgtgcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttagagagggggttaggcagagcgaaagtgacgtcattgaagagaatcttgcctgctcgcggcatgaaattgcgggtgatgcggaaagggcccgggacggaggctcggttgttgatgacctgggcggcgaggacgatctcgtcgaagccgttgatgttgtgcccgacgatgtaaagttccatgaatcgcgggcggcctttgatgtgcggcagctttttgagttcctcgtaggtgaggtcctcggggcattgcaggccgtgttgctcgagcgcccactcctggagatgtgggttggcttgcatgaaggaagcccagagctcgcgggccatgagggtctggagctcgtcgcgaaagagacggaactgctggcccacggccatcttttctggggtgacgcagtagaaggtgagggggtcccgctcccagcgatcccagcgtaagcgcacggcgagatcgcgagcgagggcgaccagctcggggtcccctgagaatttcatgaccagcatgaaggggacgagctgcttgccaaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcggcagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcagcctgacgcaggatctcttgcacgtcgcccgagttgtcctggtaggcgatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcagtggcatctcgctgatgtcgccgatggcctccagcctttccatggcctcgtagaaatccacggcgaagttgaaaaactgggcgttgcgggccgacaccgtgagctcgtcttccaggagccggatgacctcggcgatggtggcgcgcacctcgcgctcgaaatccccgggggcctcctcctcttcctcttcttccatgacgacctcttcttctatttcttcctctgggggcggtggtggtggcggggcccgacgacgacggcggcgcaccgggagacggtcgacgaagcgctcgatcatctccccgcggcggcgacgcatggtttcggtgacggcgcgaccccgttcgcgaggacgcagcgtgaagacgccgccggtcatctcccggtaatgtggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattaaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctttcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtatccgactaggaagtgcggtggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcggccgaaaaccccgccgggtagtggctcgcgcccgtagtctggagaagcatcgccagggttgagtcgcggcagaacccggttcgaggacggccgcggcgagcgggacttggtcaccccgccgatttaaagacccacagccagccgacttctccagttacgggagcgagccccctttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgtgcgagggcctggaccgccagcgcgtgctgcgcgatgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctaatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcttgagcctcgccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgttgagcctgcgccgggcgctggtagggggcgccgccggcggcgatgagtcctacttcgacatgggggcggacctgcattggcagccgagccggcgcgccttggaggccgcctacggtcccgaggacttggatgaggaagaggaagaggaggaggatgcacccgttgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccatctcggaccaaccccacgcacgagaaggtgctggcgatcgtgaacgcgctggcggagaacaaggccatccgtcccgacgaggccgggctggtgtacaacgccctgctggaacgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagtcaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctgggccagaacgacaccgacagtctgagggccaccctgaactttttgctgaccaatagacagcagaagatcccggcgcagtacgcactgtcggccgaggaggagcgcatcctgagatatgtgcagcagagcgtagggctgttcctgatgcaggagggcgccacccccagcgccgcactggacatgaccgcgcgcaacatggaacctagcatgtacgccgccaaccggccgttcatcaataagctgatggactacctgcaccgcgcggctgccatgaacacggactatttcaccaacgccattctgaacccgcactggctcccgccgccggggttctacacgggcgagtacgatatgcccgaccccaacgatgggttcctgtgggacgacgtggacagcgcggtgttctcgccgaccttgcaaaagcgccaggaggcggtgcgcacgcccgcgagcgagggcgcggtggggaggagcccctttcctagcttagggagtttgcatagcttgccgggctcggtgaacagcggcagggtgagccgaccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggacgcgcccgcgccgcggcggcagcgccacgaccggcagcggggcctggtgtgggacgacgaggactcggccgacgatagcagcgtgttggacttgggcgggagcggtggggccaacccgttcgcgcatctgcagcccaaactggggcggcggatgttttgaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaagcatcccaaagatgtagatgccagtgatttaagcaaggatatcttagagtatgattggtttgagtttaccctgcccgagggcaacttttccgagaccatgaccatagacctgatgaacaacgccatcttggaaaactacttgcaagtggggcgacaaaatggcgtgctggagagcgatatcggagtcaagtttgacagcaggaatttcaagctgggctgggacccggtgaccaagctggtgatgcctggggtctacacctacgaggccttccacccggacgtggtgctgctaccgggctgcggggtggacttcaccgaaagccgcctgagcaaccttctgggcattcgcaagaagcaacctttccaagagggattcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttgcaactccagcacaagagacagcagctgataagaaggtagaagtcttgcccattgaaaaggatgagagcggtagaagttacaacctgatccatgggacacacgacacgctgtaccgcagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctccacccagcaagtcagcaactaccccgtggtcggcgctgagctcatgcccttccgcgccaagagcttttacaacgacctcgccgtctactcccagctcatccgcagctacacctccctcacccacgtcttcaaccgcttccctgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcatacaagcgcgggcggactgccaccgccgccgccgtgcgcaccaccgttgacgacgtcatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgagctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgactagacccaggcgcggaaacgtgtactgggtgcgcgactccgtcacgggcgtgcgcgtgcccgtacgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcgacgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcctccaccgctaccgcctccacttctaccgtcgccacggccaccgagcctcccaggaggcgaagatggggtgccgccagccggctgatgcccaactacgtgttgcatccttccatcatcccgacgccgggctaccgcggcacccggtattacgccagccgcaggcgcccagccagcaaacgccgccgccgcaccgccacccgccgccgtctagcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagagaaaagctcaaagaccagaacttccagcagaaggtggtggacgggctggcctcgggcattaacggggtggtggacatcgcgaaccaggccgtgcagcgcgagataaacagccgcctggacccgcgcccgcccgccgccacggtggtggagatggaagatgcaagcgcgcatcctcctcccaggggcgagaagcgaccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccaaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagtttcaaaccctattcgggcacggcttacaacagcctggccccaaaaggtgcccccaactccagtcagtgggagcagaaaaaaactactggtggaggcaatgacatggaaacgcatacttatggcgttgcagccatgggtggagaagacattacagaaaagggccttcaaattggcattgatgaaactaaagaagaaaataacaagatatttgcagacaaaacattccaaccagaacctcaagtgggagaagaaaactggcaggaaacatttgttttttatggcggtagagctcttaagaaggacaccaaaatgaaaccatgctatggctcatttgccagacctactaatgaaaagggaggtcaggctaaatttgtacttgaccaggaaggaaagccaactaaaaatcatgatatcacaatggctttctttgatactcctggtggacaattgaatggaaaagatgagcttaaggcagacattgtcatgtacactgaaaatgtcaacctggaaacacctgacacgcatgttgtttacaaacctggaacttcagatgacagttcagaaatcaatttggttcaacagtccatgccaaatagacccaactacattggcttcagggacaactttgtagggctcatgtattacaacagcactggtaacatgggtgtgctggcaggtcaggcatctcagttgaatgctgtggtggatttgcaagacagaaacacagagctatcttaccagctcttgctagattctctgggtgacagaaccagatactttagcatgtggaactctgcggtggacagctatgatccagatgttaggatcattgagaatcacggtgtggaagatgaacttccaaactattgcttcccattggatggcgctggaactaatgcagtttaccaaggtgtaaaaattacagatggaaatgatggtgatgtcaatgatgactgggaaaaagacaccgcagtatctgaacgtaatcagatatgcaagggcaacatctatgccatggagatcaacctccaggccaacctgtggaagagttttctgtactcgaatgtggccctgtaccttcccgactcatacaagtacacgccggccaacgtcaagctgcccaccaacaccaacacctacgagtacatgaacggccgcgtggtagctccctcactggtggacgcctacgtcaacatcggcgcccggtggtcgctggaccccatggacaacgtcaaccccttcaaccaccaccgcaacgctggcctgcgctaccgctccatgcttctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgcctttcgcggctggagtttcactcgcctgaaaaccaaggaaactccctcgctcggctcgggtttcgacccctactttgtctactcgggctccattccctacctcgacgggaccttctacctcaaccacaccttcaagaaggtctccatcatgttcgactcctcggtcagctggcccggcaacgaccggctgctcacgccgaacgagttcgaaatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtattccttcttccgcaacttccagcccatgagcaggcaggtggtcgatgagatcaactacaaggactacaaggccgtcaccctgccattccagcacaacaactcgggtttcgtcggctacctcgcacccaccatgcgccaggggcagccctaccccgccaacttcccctacccgctcatcggccagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacataagcatgagcggctccagcgaaagagagctcgcggccatcgtgcgcgacctgggctgcgggccctactttttgggcacccacgacaagcgcttcccgggcttcctcgccggcgacaagctggcctgcgccatcgtcaacacggccggccgcgagacaggaggcgtgcactggctcgccttcggctggaacccgcgctcgcgcacctgctacatgttcgacccctttgggttctcggaccgccggctcaagcagatttacagcttcgagtacgaggctatgttgcgccgaagcgcgctcgcctcctcgcccgaccgctgtctcagcctcgagcagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctaccgcttccttgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcaaaggggttctcgcgctcgtcgttgtgcgccgcgctggggagggccacgttgcggaactgatacttgggctgccacttgaactctggaatcaccagtttgggcactggggtctcggggaaggtctcgctccacatgcgccggctcatttgcagggcgcccagcatgtcaggcgcggagatcttgaaatcgcagttggggccggtgctctgcgcgcgcgagttgcggtacacggggttgcagcactggaacaccatcagactggggtacttcacactggccagcacgctcttgtcgctgatctgatccttgtccagatcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggcctcgatctgcttgaaagcttgctgggccttgcccccctcgctgaagaacaggccgcagctcttcccgctgaactggttattcccgcacccggcatcctgcacgcagcagcgcgcgtcatggctggtcagttgcaccacgctccggccccagcggttctgggtcacctttgccttgctgggttgctccttcaacgcgcgctgtccgttctcactggtcacatccatctccaccacgtggtccttgtggatcatcaccgtcccatgcagacacttgagctggccttccacctcggtgcagccgtgatcccacagggcactgccggtgcactcccaattcttgtgtgcgatcccgctgtggctaaagatgtaaccttgcaacaggcgacccatgatggtgctaaaggttttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagggggttgcgcacgttcaggacaccgggggtcgcgggctcgacgatgcgttttccgtccttgccttccttcagcagaaccggcggctggctgaatcccactcccacgatcacggcttcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgctgaaccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggctttgaagagccggctcgtctagaacccccacaggatgaacaggagcacgagcaagacgcaggccaggaggagaccgacgctgggctcgagcatggctacctgggaggagaggaagatgtgctgctgaaacacttgcagcgccaatccatcatcctccgggacgccctggccgaccggagcgaaacccccctcagcgtcgaggagctgtgtcgggcctacgagctcaaccttttctcgccgcgcgtgccccccaaacgccagcccaacggcacctgcgagcccaacccgcgcctcaacttctatcccgtctttgcggtcccagaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgaactcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagcagctagcgcgctggctcgggacccgcgacccccaggctttggaacagcggcgcaagctgatgctggccgtggtcctggtcaccctcgagctcgaatgcatgcgccgcttcttcagcgaccccgagaccctgcgcaaggtcgaggagaccctgcactatacttttaggcacggcttcgtcaggcaggcctgcaagatctccaacgtggagctgaccaacctggtctcctgcctggggatcctgcacgagaaccgcctggggcagaccgtgctccactctaccctgaagggcgaggcgcgtcgggactatgtccgcgactgcgtctttctctttctctgccacacatggcaagcagccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggcggactgcccgacttcatgagccagagcatgatacaaaactaccgcactttcattctcgaacgatctgggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggcttctcgagtgccactgccgctgcaacctgtgctccccgcaccgctccctggtctgcaacccccagctcctaagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcaatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccagcaccatgagcaaagagattcccacaccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctgaactaagaacctactttggaatcccttgtcgtcatcctcgaaacaagaccgtcttctttaccaaccagaccaaggttcgtctgaactgtacaaccaacaggaagtaccttctctggactttccaaaacacctcactcgctgttgtcaatacccgtgacgacgacggtgttttaatccccaacaacctcactagtggacttacttacagtaccagaaaaactaagctcgtcctccacaaaccttttgtagagggaacctaccagtgccgacacggaccttgtgttcacacattccacttggtgaaccttaccagcagcagcacagttgctcctgaaacaactaacctttcttctgatactaacaaacctcgtgtcggaggtgagctttgggttccatctctaacagagggtgggagttctattgaagtggttgggtatttgattttaggggtggtactgggtgggtgcatagcagtgctgtatcaacttccttgctgggtcgaaatcagggtatttatctgctgggtcagacattgtggggaggaaccatgaaggggctcttgctgattatcctttccctggtggggggtgtactgtcatgccacgaacagccacgatgtaacatcaccacaggcaatgagagaagcgaatgctctgtagtcatcaaatgtgagcacaaatgttctctcaacattacattcaagaataagactatgggaaatgtctgggtgggattctggcaaccaggagatgagcagaactacacggtcactgtccatggtagcgatggaaatcacagtttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctctagtgtggttcctgaagcgcaagcccaggtacggaaatgaggagaaggaaaaattgctataaatctttttcttttcgcagaaccatgaaaactttgacaagtgtcgtgctgctctctcttttagttattaatgtggattcggcagatcctattatagttagtgtagattggggaaaaaatctaacattagaggggcctaaagaaacaccagttgaatggtggggtgggagaaacattcaacaactgtgcatagggaatcaaaccaaacataaagagctaagacacacatgtaatatgcagaacataactttgctgtctgtaaatactagttttaatggagactattttggctttaaaaatgataatagcggtatgaaacactataaagttacagttatccctcctaaaccaaccactcggaaacctttacctccaccacactatgtcaacgcaactatgggtcaaaacttaacattagtgggtccagcaaacattccagttacttggctcagtgaatttggcaccttgtgtgagggtaaaaaaattttgcatgaagaacttaatcacacctgtaacgaacagaacctcacgttgctgtttgttaatatgacacacaacgggccatattttggttttggcaaagacaatgttgacagagagcagtatgaggtctccattattagtttattcaaagtaggagcggggcaaaaaaaaatagacaaaggacaaaggacagaagagaaaacaaaattcaactcaggtgatttgggtagaaaacaatctagacctaagaaaaaagacattgttgatgaggttcaagttaaatcaggcaataatcaaactcttattggaccacctggaaaaaatgttgattggattaagctttccagcggaaacgatgctgttgtaacgttgtgtaaaggtgacacttggataaaacacacatgcaatgggccaaatgtaactttgattaatgtcacaaaaccatacgaaggaagctattatggctccagcgatgatggttcaagtcattacaaagttactgtgtatgatttatataaatcaaataaatccaagtctaaggtcaaaccttacactacaaagggcactacagtaaatgcaacaaatgccaatggcctcaaaaatgctttgcaacaggaaattggtgaatcagaaaatgatcaagaatcaaaaattccatcagctactgtggcaatcgtggtgggtgtgattgcgggctttgtaactctgatcattgtcttcatatgctacatctgctgccgcaagcgtcccaggacttacaatcatatggtagacccactactcagcttctcttactgaaactcagtcactctcatttcagaaccatgaaggctttcacagcttgcgttctgattagcatagtcacacttagtgcagctgctggtaaatgctatcatacagttaatgtcactaggggagggaatattacacttacaggggcaggaatcaacactacatggacagcttatcataacgatggaaaggggcaaaatggttggttgcccatctgtacatggggcgatcccatctatgtgtgccatggaaatagcagtactatttcaaatcttacagttgtagctcacaaaaatttaactgacagaactattaaggcatatagctatgagaacaaagatgattatgaaacagtaaattcatgcttttatgttgtaaaagttgttgagcttccaaccactaaagcgcccacacagtctactacacatccaaccaccacagccagtacaactactgagaccactactcaaactacacagctagacactacagtgcagaatagtactgtgttggttaggtttttgttgagggaggaaagtactactgaacagacagaggctacctcaagtgccttcagcagcactgcaaatttaacttcgcttgcttcggtaaatgagacgatcgtgccgctgatgtatggccaacattacccaggtttggatatacaaattactttcctgattgtctgtggggtctttatcctcgctgtccttctctactttgtctgctgcaaggccagagaaaaatctaggcggcccatctacaggccagtaatcggggaacctcagccactccaagtggatggaggcttaaggaatcttcttttctcttttacagtatggtgatcagccatgattcctaggttcttcctatttaacatcctcttctgtctcttcaacgtgtgcgctgccttcgcggccgtctcgcacgcctcacccgactgtctcgggcccttccccacctacctcctctttgccctgctcacctgcacctgcgtctgcagcattgtctgcctggtcatcaccttcctgcagctcatcgactggtgctgcgcgcgctacaattacctacaccacagtcccgaatacagggacgagaacgtagccagaatcttaaggctcatctgaccatgcagactctgctcatactgctatccctcctatcccctgtcttcacaacttctgttgattactctaaatgcaaattcgctgacatatggaatttcttagattgctatcaggagaaaattgatatgccctcctattacttggtgattgtgggaatagtcatggtctgctcctgcactttctttgccatcatgatctacccctgttttgatctcggctggaactctgttgaggcattcacatacacactagaaagcagttcactagcctccacaccaccacccacaccgcctccccgcagaaatcagttccccatgattcagtacttagaagagccccctccccggcccccttccactgttagctactttcacataaccggcggcgatgactgacaaccacctggacctcgagatggacggccaggcctccgagcagcgcgtcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctgctcaaaaccctttgcggactccgcgacctcctccccatgaactgatgttgattaaaagcccaaaaaccaatcagccccttcccccatttccccatcccccaattactcataaaaataaatcattggaactaatcattcaataaagatcacttacttgaaatctgaaagtatgtctctggtgtagttgttcagcagcacctcggtaccctcctcccagctctggtactccaatccccggcgggcggcgaacttcctccacaccttgaaagggatgtcaaattcctggtccacaattttcattgtcttccctcttagatgtcaaagaggctccgggtggaagatgacttcaaccccgtctacccctatggctacgcgcggaatcagaatatccccttcctcactcccccctttgtctcttccgatggattccaaaacttcccccctggtgtcctgtcactcaaactcgctgacccaatcactatcaacaatggggatgtctcgctcaaggtgggagggggactcactgttgaacaacagtctggaaatttaactatagatgccaaagcacctttgcaagttgcaaatggtaaattagacattgctttggcaccaccatttgaagttaaagataataaactttctttactagttggaaatggactaaaggtgatagatagatcagtctctgacttgccaggtcttctaaactaccttgtagtattgactggcaaaggcatcggaaatgaagagataaaaaacgcagacggaacaaacaaaggagttggattgcgtgtgagaatcgcagaagcaggtggcttaacatttgatgataaaggtgaattagtggcctggtataaaaacaatgataagcgcaccctttggacaactctggatccatctccaaattgcagagttgatgaagaaaaggattcaaagtttactttagttttaacaaagtgtggaagtcagattctggctagtgtatcactattgattgtaaaaggtaaattccaaattttagatcataaggccaacactggccttagtaaagcttttgcaattaagttactatttgatgaaaatggagtccttaaagactcatcaaacattgacaagaactcttggaattatagaagcgggaattctgttctgtcagagccatataaaaatgcaattggatttatgccaaatttagcagcgtatcctaaatctacaacttctggttctaagatttatgcaagaaatactatttttggaaatatttacttagattcacaagcatataatccagtggttattaaaattacttttaatcaagaagcagatagtgcttattctatgacttttaactattcatggaccaaggattatgaaaaagtcccttttgattctacttcttttacattttgctatatcgcccaagaatgaaagaccaataaacgtgtttttcatttgaaaattttcatgtatctttattgatttttacaccagcacgggtagtcaatctcccaccaccagcccatttcacagtgtacacggttctctcagcacgagtggccttaaatagggaaatgttctgattagtgcgggaactggacttgggatctataatccacacagtttcctggcgagccaaacgggggtcggtgattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcaacagtctctgccgccggggctcggtgcggctgctgcagatgggatcgggatcgcaagtctctctgactatgatcccaacagccttgagcatcagtctcctggtgcgtcgggcacagcaccgcatcctgatctctgccatgttctcacagtaagtacagcacataatcaccatgttattcagcagcccataattcagggtgctccagccaaagctcatgttggggatgatggaacccacgtgaccatcgtaccagatgcggcagtatatcaggtgcctgcccctcatgaacacactgccc

SEQ ID NO: 1434 - DNA, 32767 bp, Human mastadenovirus D
catcatcaataatataccccacaaagtaaacaaaagttaatatgcaaatgagctcttgaattttaacggttttggggcggagccaatgctgattggccgagaagcggtgacgcagttgacgtcacgacgcacggccgacgctcgccgcggaggcgtggcctagcccggaagcaagtcgcggggctgatgacgtataaaaaagcggactttagacccggaaacggccgattttcccgcggccacgcccggatatgaggtaattctgggtggatgcaagtgaaattaggccattttggcgcgaaaactgaatgaggaagtgaaaagtgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtctgagaaaaatgagacacctgcgcctcctgccttcaactgtgcctatggacatggctgtgcttatgctggatgactttgtgaatacagtattggaggatgaactgcatccaactccgttcgagctgggacccacacttcaggacctctatgatctggaggtagatgcccaggaggacgacccgaacgaagaggctgtgaatttaatatttccagaatctatgattcttcaggctgacatagccagtgaagccatagttactcctctacatactccaactctgcctcccatacctgaattggaggaggatgaagaaatagacctccggtgctacgaggaaggttttcctcccagcgattcagaggacgaacagggtgagcagcagatggctctaatctctgatttagcttgtgtgattgtggaggaacaagttgtgattgaaaaatctaccgagccagtacaaggctgtaggaactgccagtatcaccgggataagtccggagacccgaacgcttcctgcgctctgtgttacatgaaatctactttcagctttatttacagtaagtggagtgaatgtgagagaggctgagtacttaacacataactgtaatgcttgaacagctgtgctaagtgtggtttatttttgttactaggtccggtgtcagaggatgagtcatcaccctcagaagaagaccacccgtctccccctgatctcacagatgacacgcccctgcaagtgttcagacccaccccagtcagagccagtggcgagaggcgagcggctgttgacaaaattgaggacttgttgcaggacatgggtggggataaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataacgaggaatttgaaaatctttttgctgactgctctggcctgctagattctctgaatcttggccaccagtcccttttccaggaaagggtactccacagtcttgatttttccagcccagggcgcactacagccggggttgcttttgtggtttttctggttgacaaatggagccagaacacccaactgagcaggggctacattctggacttcgcggccatgcacctgtggaggtcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtgaagagggagaggagcgatgggggcaataccgggatgatgaccgagctgacggccagcctgatgaatcgcaagcgcccagaacgcattacctggcacgagctacagatggagtgcagggatgaggtgggcctgatgcaggataaatatggcctggagcagataaaaacccactggttgaacccagatgaggattgggaggaagccattaagaaatatgccaagatagccttgcgcccagattgcaagtacagggtgaccaagaccgtgaatatcagacatgcctgctacatctcggggaacggggcagaggtggtcatcgataccctggacaaggccgcctttaggtgttgcatgatgggaatgagagccggagtgatgaatatgaattccatgatcttcatgaacatgaagttcaatggagagaagtttaatggggtgatgttcatggccaacagccacatgaccctgcatggctgcagtttctttggtttcaacaatatgtgtgcagaggtctggggcgctgctaagatcaggggatgtaagttttatggctgctggatgggcgtggtcggaagacccaagagcgagatgtctgtgaagcagtgtgtgtttgagaaatgctacctgggagtctctactgagggcaatgctagagtgagacactgctcttccctggagacgggctgcttctgcctggtgaagggcacggcctctctgaagcataatatggtgaagggctgcacggatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggcgccagaaggggcaccttccagccgtaccagtgcaactttagccagaccaagctgctgttggagaacgatgccttctccagggtgaacctgaacggcatctttgacatggatgtttcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcatgtaccgggaccgagttcagctccagtggggaggacacagattagaggtaggttttgagtagtgggcgtggctaaggtgagtataaaggcggtgtcttacgagggtctttttgcttttctgcagacatcatgaacgggaccggcggagccttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcgctcgacagcaccgccgcagccgcggcagccgcagccgccatgacagcgacgagactggcctcgagctacatgcccagcagcggtagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgattcaataaacacagattctgattcaaacagcaaagcatctttattatttattttttcgcgcgcggtaggccctggtccacctctcccgatcattgagagtgcggtgaattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgaggaggagactaatggccacggggagccccttggtgtaggtgttggcaaagcggttgagctgggagggatgcatgcggggggagatgatgtgcagtttggcctggatcttgaggttggcaatgttgccgcccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagacacatcataattatgctcctgggtgagatcatcataagacattttaatgaatttggggcgaagggtgccagattgggggacgatggttccctcgggccccggggcgaagttcccctcacagatctgcatctcccaggctttcatctcggagggggggatcatgtccacctgcggggcaatgaaaaaaacggtttccggggcgggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccaaggaggcggtccccgcccagcgagaggagctcttgcagggaagcaaagtttttcaggggcttgagcccgtcggccattggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagtgtccgcgtgagggtggtctccgtcacggtgaatgggtgggccccgggctgggcgcttgcaagggtgcgcttgagactcatcctgctggtgctgaaacgggcacggtcttcgccctgcgcgtcggcgagatagcagttgaccatcagctcgtagttgagggcctcggcggcgtggcccttggcgcggagcttgcccttggaagagcgcccgcaggcgggacataggagggattgcagggcgtagagcttgggcgcgagaaagaccgactcgggggcgaaggcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagacaatttttttattgtcaagcttggtggcgaaggagccatagagggcgttggagagaagcttggcgatggatctcatggtctgatttttgtcacggtcggcgcgctccttggccgcgatgttgagctggacatattcgcgcgcaacacacttccattcgggaaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacggtggcagcacatcaagcagattctcgtcaggggggtccgcatcgatggtgaagatgcccggacagagttccttgtcaaaataatcgatttttgaggatgcatcatccaaggccatctgccactcgcgggcggccatcgctcgctcgtaggggttgaggggcggaccccagggcatgggatgcgtgagggcggaggcgtacatgccgcagatgtcgtagacatagatgggctccgagaggatgccgatgtaggtgggataacagcgccccccgcggatgctggcgcgcacgtaatcatacaactcgtgcgagggggccaagaaggcggggccgagattggtgcgctggggctgctcggcgcggaagacgatctggcgaaagatggcatgcgagtttgaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttgtcccacagctcgcggttgagggcgtactcctcgtcatccttccagtactcccggagcgggaatcctcgatcgtccgcacggtaagagcccagcatgtagaaatggttcacggccttgtagggacagcagcccttctccactgggagggcgtaagcttgtgcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggagttaggcagagcgaaagtgacgtcattgaagagaatcttgcctgcccgcggcatgaaattgcgggtgatgcggaaagggcccggaacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaaggaagcccagagctcgcgggccaggagggtctggagctcgtcgcgaaagaggcggaactgctggcccacggccatcttttcgggtgtgacgcagtagaaggtgagggggtcccgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgattggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcacgcagttgggagctgtccatggtgtcgcggagatccaggtccgggggcagggttctgaggttgacctcgtagaggcgggtgagggcgtgcttgagatgcagatggtacttgatctccacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctccacggtggcggcgaggtcatttgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcttcgtagaaatccacggcgaagttgaaaaactgggcgttgcgggccgacaccgtgagctcgtcttccaggagccggatgagctcggcgatggtggcgcgcacctcgcgctcaaaatccccgggggcctcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcaaggaaagcgtctagccaatcgcagtcgcaaggtaagctcaaacacgtagcagccctgtggacgctgttagaattgcggttgctgatgatgtaattgaagtaggcgtttttaaggcggcggatggtggcgaggaggaccaggtccttgggtccagcttgctggatgcggagccgctcggccatgccccaggcctggccctgacaccggctcaggttcttgtagtagtcatgcatgagcctttcaatgtcatcacttgcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttaacggtctgcaggccgggctgcacgacctccgagtacctgagccgcgagaaggcgcgcgagtcgaagacgtagtcgttgcaggtgcgcacgaggtactggtagccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaataatccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagggggtcgctcgacttgaaagcggccgaaaaccctgtcgggtagtggctcgcgcccgtagtctggagaagcatcgccagggttgagtcgcggcagaacccggttcgcggacggccgcggcgagcgggacttggtcaccccgccaatttaaagacccacagccagccgacttctccagttacgggagcgagcccccttttttctttttgccagatgcatcccgtcctgcgccaaatgcgtcccgcccccccggcgaccaccgcgaccgcggccgtagcaggcgccggcgctagccagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccgttttcgggcgggcagggagctgcgcgagggcttggaccgccagcgcgtgctgcgcgacgaggatttcgagccgaacgagcagacggggatcagccccgctcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcaaagcatcgtagtgcaggagcgcagcctgagcctggccgagaaggtggcggcgatcaactactcggtgttgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgcttagcctgcgccgggcgctggtagggggcgccgccggcggcgaggagtcctacttcgacatgggggcggacctgcattggcagccgagccggcgcgccttggaagccgcctacggtccagaggacttggatgaggatgaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctctctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgataccgacagtctgagggccaccctgaactttttgctgaccaatagacagcagaagatcccggcgcagtacgcactgtcggccgaggaggaaaggatcctgagatatgtgcagcagagcgtagggctgttcctgatgcaggagggcgccacccccagcgccgcgctggacatgaccgcgcgcaacatggaacctagcatgtacgccgccaaccggccgttcatcaataagctgatggactacctgcaccgcgcggcggccatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcacatctgcagcccaaactggggaggcggatgttttgaaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaaaaggcggaaggggctgatgcaaatgataggagcaaggatatcttagagtatcagtggtttgagtttaccctgcccgagggcaacttttccgagaccatgaccatagacctgatgaacaacgccatcttggaaaactacttacaagtggggcggcagaatggcgtgctggagagcgatatcggagtcaagtttgacagcaggaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagtagggggcaacatccccgccctgcttgatgtgcccaagtacttggaaagcaagaagaaactggaggaaggcgctaaggaagctggcaacaccaaagctccaattagaggagatacttatgctaccacagctgaggaagaggctgctaaaaaagagttagttattttgccagtaacagaagatgaaagcaaaagaagctataatttaattgagggaaccacagacacgctgtaccgaagctggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctctccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcatacaagcgcgggcggactgccaccgccgccgccgtgcgcaccaccgtcgacgatgtcatcgactcggtggtcgccgatgcgcgcaactatacccccgccccctccaccgtggacgcggtcatcgacagcgtggtggccgacgcgcgcgactatgccagacgcaagagccggcggcgacggatcgccaggcgccaccggagtacgcccgctatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatttctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtattcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgagagcaatcccacgccgagcctgaagcccgtgaccctgcagcaggtgctgccccaggcggtgctgctgccgagccgcgggatcaagcgcgagggcgagaacatgtacccgaccatgcagatcatggtgcccaagcgccggcgcgtggaggaagtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggccaccgagcctcccaggaggcgaagatggggccctgccaaccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctagccacgggtgtaatgaaacccgccacccttgacctgcctccaccacccacgcccgctccaccgaaggcagctccggtcgtgcaggcccccccggtggcgactgccgtgcgccgcgtccccgcccgccgtcaggcccagaactggcagagcacgctgcacagtatcgtgggcctgggagtgaaaagtctgaagcgccgccgatgctattgacagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagtttcaaaccctactcgggcacagcctacaacagcctggcccccaagggtgcccccaatcctagtcagtggattaccaaagaaaagcaaaccggagtaaatgcaggagacaaagatgttacaaagacatttggaattgccgccatgggaggcagtaatatttctaaagacggtttacagattggaactgacacaacagcagctgctgcaaaaccaatatatgcagacaaaactttccagccagaacctcaagttggagaagaaaactggcaggataatgatgaatattatggcggcagggctcttaaaaaagataccaaaatgaagccatgctatggttcatttgctaaacccacaaacaaggaaggtgggcaggctaaattgaaagaaacacccaatggtgccgatcctcaatatgatgtggacatggctttctttgactcaaccactataaatataccagatgttgtgttatacactgaaaatgtagatttggaaactccagatacacatgtggtgtacaaaccaggcaaagaggatgacagttctgaagctaatttaactcagcagtccatgcctaacagaccaaactacattggcttcagagacaactttgtggggctattgtactacaacagcactggcaacatgggtgtgctggctggtcaggcatctcagttgaatgccgtggtcgacttgcaagacagaaacaccgaactgtcttaccagctcttgctagattctctgggtgacagaaccagatattttagtatgtggaactctgcggtggacagctatgatcccgatgtcaggatcattgagaaccacggtgtggaagacgaacttcctaactattgcttccccttggacggtgttcaaactaattcagcctaccaaggtgttaaactaaaggctaatccagcaggaggcggagctaatggagattgggaaaaggatgataccatttcagtccataatcaaattggaaagggcaacatctttgccatggagatcaacctccaggccaacctgtggaaaagttttctgtactcgaacgtggccctgtacctgcccgactcctacaagtacacgccggccaacgtcacgctgcccaccaacaccaacacctacgactacatgaacggccgcgtggtagccccatccctggtggacgcctacatcaacatcggcgcccgctggtcgctggatcccatggacaacgtcaaccccttcaaccaccaccgcaatgcggggctgcgctaccgctccatgcttctgggcaacggccgctacgtacccttccacatccaagtgccccaaaagttctttgccatcaagaacctgctcctgctccccggctcctacacctacgagtggaacttccgcaaggatgtcaacatgatcctgcagagctccctcggcaacgacctgcgcgtcgacggcgcctccgtgcgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatccctgccaaggccaccaacgtgcccatctccattccctcgcgcaactgggccgccttccgcggctggagtttcacccggctcaagaccaaggaaactccctccctcggctcgggtttcgacccctactttgtctactcgggctccattccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttctacgtgcccgagggctacaaggaccgcatgtactccttcttccgcaacttccagcccatgagcaggcaggtggtcgatgagatcaactacaaggactacaaggccgttaccctgccattccagcacaacaactcgggcttcaccggctacctcgcacccaccatgcgtcaggggcagccctaccccgccaacttcccctacccgctcattggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgccattctccgccggcaacgccaccacctaagcatgagcggctccagcgaacgagagctcgcggccatcgtgcgcgacctgggctgtgggccctactttttgggcacccacgacaagcgattcccgggcttcctcgccggcgacaagctggcctgcgccatcgtcaacacggccggccgcgagaccggaggcgtgcactggctcgcctttggctggaacccgcgctcgcgcacctgctacatgttcgacccatttgggttctcggaccgccggctcaagcagatttacagcttcgagtacgaggccatgctgcgccgaagcgccctggcctcctcgcccgaccgctgtctcagcctagagcagtccacccagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactccccttactttcgctcccaccgcgccgccatcgaacatgccaccgcttttgataaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcacccagcatgtccgggccggagatcttgaaatcgcagttggggccggtgctctgcgcgcgcgagttgcggtacacggggttgcagcactggaacaccataagactggggtacttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccgcacccggcatcctgcacgcagcagcgcgcgtcatggctggtcagttgcaccacgctccgtccccagcggttctgggtcaccttggccttgctgggttgctccttcaacgcgcgctgcccgttctcactggtcacatccatctccaccacgtggtccttgtggatcatcaccgttccatgcagacacttgagctggccttccacctcggtgcagccgtggtcccacaggacgcagccggtgcactcccagttcttgtgcgcgatcccgctgtggctgaagatgtaaccttgcaacatgcggcccatgatggtgctaaaggttttctgagtggtgaaagtcagttgcagaccgcgagcctcctcgttcatccaggtctggcacatcttttggaagatctcggtctgctcgggcattagcttgtaagcatcgcgcaggccgctgtcgacgcggtagcgttccatcagcacgttcatggtatccatgcccttctcccaagacgagaccagaggcagacttagggggttgcgcacgttcaggacaccgggggtcgcgggctcgacgatgcgttttccgtccttgccttccttcaacagaaccggcggctggctgaatcccactcccacgatcacggcttcttcctggggcatctcttcgtcggggtctaccttggtcacatgcttggtcttcctggcttgcttcttttttggagggctgtccacggggaccacgtcctcctcggaagacccggagcccacccgctgatactttcggcgcttggtgggcagaggaggcggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatgactacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggagcagcggcgcaagctcatgctggccgtggtcctggtcaccctcgagctcgaatgcatgcgccgcttcttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggacagaccgtgctccactctaccctgaagggcgaggcgcgtcgggactatgtccgcgactgcgtctttctatttctctgccacacatggcaagcggccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctaaaaggcggcctgcccgacttcatgagccagagcatgttgcaaaattaccgcactttcattctcgagcgctcggggatcctgcccgccacctgcaacgccttcccctccgactttgtcccactgagctaccgcgagtgtcccccgccgctgtggagccactgctatctcttgcagctggccaactacatcgcctaccactcggacgtgatcgaggacgtgagcggtgaggggcttctcgagtgccactgccgctgcaacctgtgctctccgcaccgctccctggtctgcaacccccagctcctgagcgaaacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcgggcaacagagcagcccgtcgccgcaccatccgcgccggcagcccctccggtcacggatacaacctccgcagctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagagaagtcgccggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccccgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgtggcctcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtgctgagtttaataaaagctgaaataaaaatcttctctggaccttgtcatcgacctcggaacagcaccgtcttactcaccaatcagaccaaggttcgtctgaactgcacaaccaacaggaagtaccttctctggactttccaaaacacctcactcgctgttgtcaacgcccgtgacgacgacggtgttttaatccccaacaacctcaccagtggacttactttcagcacaagaaaaactaagctcgtcctccacaaaccttttgtagagggaacctaccagtgccgacacggaccttgtgttctcaacttccatttggtgaacattaccagcagcagtacagttgctcctgaaacaactaacctttcttctgatactaacaaacctcgtgtcggaggtgagctttgggttccctctctaacagagggtgggagttctattgaagtggttgggtatttgattttaggggtggtcctgggtgggtgcatagcggtgctatatcaccttccttgctgggtcgaaatcagagtctttatctgctgggtcagacattgtggggaggaaccatgaaggggctcttgctgattatcctttccctggtggggggtgtactgtcatgccacgaacagccacgatgtaacatcaccacaggcaatgagagaagcgaatgctctatagtgatcaaatgtgagcacaaatgttctctcaacatcacattcaagaataagaccatgggaaatgtatgggtgggattctggcaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggagaacatggtgggtttttctttggcttttgtgatcatggcctgctttatgtcaggtctgctggtaggggctctagtgtggtttctgaagcgcaagcccaggtatggaaatgaggagaaggaaaaattgctataaatctttttctcttcgcagaaccatgaatactttgaccagtgtcgtgctgctctctcttcttgtagcttttagtcagggacaagctgtgcatgtgaaacttgaaatttgttatggttgtaatggtacactaataggaccacataaaactccagttgagtggtatgacggcagaggacacaaactttgtgcaggatctgatacttttcacaaggaactaaatcacacatgtgatttacaaaatatgacacttacatttgttaacttaactcataagggtacttactatggttttggcagtgataacaaaaactctaaagtataccaggttactattaagccacctgttctgacaactcgcaggcctttattaaaacctgaagatattgtaatcactaagggaagcaacaaaactcttgtgggtcctccagatacaccagttgactggtatgatggttcaggacataaattgtgtaaaggaaaagaagttcattaccctgaactcaatcacacctgtgatgagcagaaccttacactcatatttgtaaatgccacttttaagggaacctattatggctttagaaaagatggcacagacaaaaaggaatatagagtcaaaattgatgatttatatgcaaaacaactaaaacaggaaaaagatgaaaaaccaaggtctggccatgataagcagaaatcaaaaacagaagaaaaacaaaatccaaaaacagaagaaaggcatgggcatagagatgttgttaaagaagttagttttagaactggaactaatcaaactctagtgggcccaccagggtctaaggttgattggcttaaagttggaaatggtgggacatttagcgaactttgtaaaagcgataataaacactattcttgtaattctcaaaacttaacaataatcaatgttaccagatttgatgaaggtagctattatggctctaatgacggttcagctcattacagagtttcagtctatgacccagtacagaaaaaaagggttatgaaaatacaaccacacacaacaaaaactactgcaaaaaaaactacaaaaagcagcgctaatgaaacagatgaaaactttgctttgcaacagggtaacaatggggaaaatcaatatgatgaaactaatattccttcaactactgtggcaatcgtggtgggagtgattgcgggcttcataactataatcattgtcattctgtgctacatctgctgccgcaagcgtcccagggcatacaatcatatggtagacccactactcagcttctcttactgagactcagtcactttcatttcagaaccatgaaggctttcacagcttgcgttctgattagcctagtcacacttagtttagccaaaattaatcaaatcagtgtcaaaagaggtgaaaatgttacactagatggaacttatccaaatactacatggacaagatatcaccttacaaaatgggataatatttgcaaatggaatatttcaacatataaatgtcataataatggaagcattacaattcatacttttaatatcacttctggattatacaagggagatagctataaaagagaagtgataacatcaatgtctaaatttggaaatatgacagacacttatttcagcgaatatcaacaattaaaaatgtataatttaacaataattgaaccaccaactactaaagcacccactaccactaagcctaccacagttaagacaacacaacctaccactgtgcccactacacatccaaccaccgcagtcagtacaactattgaaaccactactcacactacacagctagacactacagtgcagaatagtactgtgttggttaggtatctgttgagggaggaaagtactactgaacagacagaggctacctcaagtgccttcagcagcactgcaaatttaacttcgcttgcttcaataaatgagaccctcgtgccgatgaaacaggatcaacctaattactcaggtttggatatgcaaattactttcttaattgtctgtggagtctttattcttgtggttcttctttactttgtcttttgcaaagccagacaaaaatctcatagaacaatctacaggccagtgattggggaacctcagcccctccaagtggacggaggcttaaggaatcttctcttctcttttacagtatggtgatcagccatgattcctaggttcttcctatttaacatcctcttctgtctcttcaacatctgtgctgccttcgcggccgtctcgcacgcctcacccgactgtctcgggcccttccccacctacctcctctttgccctgctcacctgcacctgcgtctgcagcattgtttgcttggtcgtcaccttcctgcagctcatcgactggtgctgcgcgcgctacaattatctccaccacagtcccgaatacagggacgagaacgtagccagaatattaaggctcatatgaccatgcagactctgctcatattgctatccctcttatcccctgccattgccgctcctgattactctaaatgcaaatttgtggaactatggaatttcttagactgctatgatgctaaaatggatatgccttcctattacttggtaattgtggggatagtcatggtctgctcatgcactttctttgccatcatgatctacccctgttttgatctcggctggaattctgttgaggcattcacatacacactagaaagcagttcactagcctccacgccaccacccacaccgcctccccgcagaaatcagttccccttgatacaatacttagaagagccccctccccgacccccttccactgttagctactttcacataaccggcggcgatgactgaccacctggacctcgagatggacggccaggcctccgagcagcgcaccctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaaacagcatcgcctcgcctatgagctgccccagcagaagcagaagttcacctgcatggtgggcatcaaccccatagtcatcacccagcagtcgggcgagaccagcggctgcatccactgctcctgcgaaagccccgagtgcatctactcactgctcaagaccctttgcggactccgcgaccttctccccatgaactgatgttgattaaaatcccagaaaccaatcagccccttaccccattcccctccccaattactcataacacatttggaattaatgattcaataaagatcacttacttgaaatctgaaagtatgtctctggtgtagttgttcagcagcacctcggtaccctcctcccagctctggtactccagtcctcggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttccttactcccccctttgtctcatccgatggattcaaaaacttcccacctggggtcctgtcactcaaactggctgacccaatcgccatcactaatggggatgtctcactcaaggtgggagggggactaactgtggaacaagatagtggaaacctaagtgtaaaccctaaggctccattgcaagttggaacagacaaaaaactggaattggctttagcacctccatttgatgtcagagataacaagctagctattctagtaggagatggattaaaggtaatagatagatcaatatctgatttgccaggtttgttaaactatcttgtagttttgactggcaaaggaattggaaatgaagaattaaaaaatgacgatggtagcaataaaggagtcggtttatgtgtgagaattggagaaggaggtggtttaacttttgatgataaaggttatttagtagcatggaacaataaacatgacatccgcacactttggacaactttagacccttctccaaattgtaagatagatatagaaaaagactcaaaactaactttggtactgacaaagtgcggaagtcagattttggcaaatgtatctctaattatagtcaacggaaagtttaagatccttaataacaaaacagacccatccctacctaaatcatttaacatcaaactactgtttgatcaaaatggagttctattggaaaattcaaacattgaaaaacagtacctaaactttagaagtggagactctattcttccagagccatataaaaatgcaattggatttatgcctaatttactagcttatgctaaagctacaactgatcagtctaaaatttatgcaaggaacactatatatggaaatatctacttagataatcagccatataatccagttgtaattaaaattacttttaataatgaagcagatagtgcttattctatcacttttaactattcatggaccaaggactatgacaatatcccttttgattctacttcatttaccttctcctatatcgcccaagaatgaaagaccaataaacatgttctcatttgaaaattttcatgtatctttattgatttttacaccagcacgggtagtcagtctcccaccaccagcccatttcacagtgtaaacaattctctcagcacgggtggccttaaatagggaaatgttctgattagtgcgggaactggacttggggtctataatccacacagtttcctggcgagccaaacgggggtcggtgattgagatgaagccgtcctctgaaaagtcatccaagcgggcctcacagtccaaggttacagtctggtggaatgagaagaacgcacagattcatactcggaaaacaggatgggtctgtgcctctccatcagcgccctcagcagtctctgccgccggggctcggtgcgactgctgcagatgggatcgggatcacaagtctctctgactatgatccccacagccttcagcatcagtctcctggtgcgtcgggcacagcaccgcatcctgatctctgccatgttctcacagtaagtgcagcacataatcaccatgttattcagcagcccataattcagggtgctccagccaaagctcatgttggggatgatggaacccacgtgaccatcgtaccagatgcggcagtatatcaggtgcctgcccctcatgaacacactg

SEQ ID NO: 1435 - DNA, 32767 bp, Human adenovirus 69
catcatcaataatataccccacaaagtaaacaaaagttaatatgcaaatgagcttttgaatttagggcggggccagcactgattggccgttgcaagaaccgttagtgacgtcacgacgcacggcgtcaacggtcgccgcggaggcgtggcctagtccggaagcaagtcgcggggctgataacgtataaaaaagcggactttaaacccggaaacggccgattttcccgcggccacgcccggatatgaggtaattctgggcggatgcaagtgaaattaggccattttggcgcgaaaactgaatgaggaagtgaaaagtgaaaaataccgggcccgcccagggcggaatatttaccgagggccgagagactttgaccgattacgtgggggtttcgattgcggtgttttttcgtgaatttccgcgtccgtgtcaaagtccggtgtttatgtcacagatcagctgatccacagggtatttaaaccagtcgatcccgtcaagaggccactcttgagtgccagcgagtagagatttctctgagctccgctcccagagtctgagaaaaatgagacacctgcgcctcctgtcttcaactgtgcctattgacatggccgcattattgctggaggattatgtgagtacaatattggaggacgaactgcatccatctccattcgagctgggacctacacttcaggacctatatgatttggaggtagatgcccatgatgacgacccgaacgaagaggctgtgaatttaatatttccagaatctctgattcttcaggctgacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatgactctaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtaaatgtgagagagactgagtgcttaacacataactgggtgatgcttaaacagctgtgctaagtgtggtttatttttgtttctaggtccggtgtcagaggatgagtcatcaccctcaaaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctaagcttgaaacgccccaggaactaggctcagctgtgcttagtcatgtgtaaataaagttgtacaataaaagtatatgtgacgcatgcaaggtgtggtttatgactcatgggcgtggcttagtcctatataagtggcaacacctgggcactggggcacagaccttcagggagttcctgatggatgtgtggactatccttgcagactttagcaagacacgccggcttgtagaggatagttcagacgggtgctccgggttctggagacactggtttggaactcctctatctcgtctggtgtacacagttaagaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggccaggggagtgaagagggagaggagcgatgggggcaataccgggatgatgaccgagctgacggccagcctgatgaatcgcaagcgcccagagcgcattacatggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcgggtaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgttggatgggcgtagtgggaagacccaagagtgagatgtctgtgaagcagtgtgtgtttgagaaatgctacctgggagtctctaccgagggcaatgctagagtgagacactgctcttccctggatacgggctgtttctgcctggtgaagggtacggcctctctgaagcataatatggtgaagggctgcacagatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaggtccagggtgcgcgcttgcgagtgcgggggcagacacaccaggatgcagcctgtggccctggatgtgacagaggagctgagaccagaccacctggtgatggcctgtaccgggaccgagttcagctccagcggggaggacacagattagaggtaggtttgagtagtgggcgtggctaatgtgagtataaaggtgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggaactcgtcgctcgacagcaccgccgcagccgcggcagccgcagccgccatgacagcaacgagactagcctcgagctacatgcccagcagcggtagcagcccctctgtgcccagttccatcatcgccgaggagaaactgctggccctgctggccgagctggaagccctgagccgccagctggccgccctgacccagcaggtgtccgagctccgcgagcagcagcagcaaaataaatgattcaataaacacagattctgattcaaaagcaaagcatctttattatttattttttcgcgcgcggtaggccctggtccacctctcccgatcattgagagtgcggtggattttttccaggacccgatagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccgcccagatcccgccgggggttcatgttgtgcaggaccaccaggacggtgtagcctgtgcacttggggaacttgtcatgcaacttggaagggaatgcgtggaagaatttggagacgcccttgtgcccgcccaggttttccatgcactcatccatgatgatggcgatgggtccgtgggctgcggctttggcaaagacgtttctggggtcagagacatcataattatgctcctgggtgagatcatcataagacattttaatgaatttggggcggagggtgccagattgggggactatggttccctcgggccccggggcgaagttcccctcacagatctgcatctcccaggctttcatctcggaggggggaatcatgtccacctgcggggcgatgaaaaaaacggtttccggggcgggggtgatgagctgcgaggagaggaggtttctcagcagctgggacttgccgcacccggtcggaccgtagatgaccccgatgactggttgcaggtggtagttcaaggagatgcagctgccgtcgtcccggaggaggggggccacctcgttaagcatgtctctgacttggaggttttcccggacgagctcgccgaggaggcggtccccgcccagcgagaggagctcttgcagggaagcaaagtttttcaggggcttgagtccgtcggccatgggcatcttggcgagggtctgcgagaggagttccaaccggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaatgggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagctttcctttggaagagcgcccgcaggcgggacataggagggattgcagggcgtagagcttgggcgctagaaagacggactcgggggcgaaggcgtccgctccgcagtgggcgcagacggtctcgcactcgacgagccaggtgagctcggggtgatcggggtcaaaaaccagttttcccccgttctttttgatgcgcttcttacctcgcgtctccatgagtctgtgtccgcgttcggtgacaaacaggctgtctgtgtccccgtagacggacttgatgggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccacggtatgcagacacatgtccccctcctccgcatccaagaaggtgattggcttgtaggtgtaggccacgtgacctggggtccccgacgggggggtataaaagggggcgggtctgtgctcgtcctcactctcttccgcgtcgctgtctacgagcgccagctgttggggtaggtattccctctcgagagcgggcatgacctcggcactcaggttgtcagtttctagaaacgaggaggatttgatgttggcctgccctgccgcgatgcttttgagtaaactttcatccatctggtcagaaaagacaatttttttattgtcaagcttggtggcgaaggagccatagagggcgttggagagaagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatccaggaggtgctcgtcgggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccaaggcatgggatgtgtgagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcatgcgagtttgaggagatggtgggccgttggaagatgttaaagtgggcgtggggcaggcggaccgagtcgcggatgaagtgcgcgtaggagtcttgcagcttggcgacgagctcggcggtgacgaggacgtccatggcgcagtagtccagtgtttcgcggatgatgtcataacccgcctctcctttcttctcccatagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcacgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcatgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacaagggcgcgcagttgggagctgtccatggtgtcgcggagatccaggtcagggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacttcggcgtggcgctcgggcaggtcccggtgctgcgccctgagagcgctggcgtgcgcgacgacgcggcggttgacatcctggatctgccgcctctgtgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcgttggagatgcgacccatgagctgcgagaaggcgcccaggccgctctcgttccagacgcggctgtagaccacgtccccgtcggcgtcgcgcgcgcgcatgaccacctgcgctaggttgagctccacgtggcgcgtgaagacagcgtagttgcgcaggcgttggaagaggtagttgagggtggtggcgatgtgctcggtgacgaagaagtacatgatccagcggcgcaggggcatctcgctgatgtcgccgatggcctccagcctttccatggcctcgtagaagtccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttccatgacgacctcttcttctatttcttcctctgggggcggtggtggtggcggggcgcgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctttcaatgtcatcactggcggaggcagagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaggtgcagttggccatgagcgaccagttaacggtctgcaagccgggctgcacgacctccgagtacctgagccgcgagaaggcgcgcgagtcgaatacgtagtcgttgcaggtgcgcacgaggtactggtatccgactagaaagtgcggcggcggctggcggtagagcggccagcgctgggtggccggcgcgcccggggccaggtcctcgagcatgaggcggtggtagccgtagacgtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgccggccgaggggggtcgctagacttgaaagcggccgaaaaccctgtcgggcagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgagtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacgggcatcagccccgcgcgcgctcacgtggcggcggccaatctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctaacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcctgagcctggccgagaaggtggcggcgatcaactactcggtgttgagcctcggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctcatgctgagtctgcgccgggcgctggtagggggcgccgccggcggcgaggagtcctacttcgacatgggggcggacctgcattggcagccgagccggcgcgccttggaggccgcctatggtccagaggacttggatgaggaagaggaagaggaggaggatgcacccgttgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggctattctggaggcggtggtcccctctcggaccaaccccacgcacgagaaggtgctggcgatcgtgaacgcgctggcggaaaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgttggtggcgctgaacgccttcctggcgacgcagccggcgaacgtgccgcgcgggcaggacgattataccaactttatcagcgcgctgcggctgatggtgaccgaggtgccccagagcgaggtgtaccagtcgggcccggactactttttccagactagcagacagggcctgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggtcacctgctgacgctgtaccgcgaggccataggccaggcgcaggtggacgagcagaccttccaggagatcactagtgtaagccgcgcgctgggtcagaacgacaccgacagtcttagagccaccctgaacttcttgctgacaaatagacagcagaagattccggcgcagtacgcgctgtcggccgaggaggagcgcatcctgagatatgtgcagcagagcgtagggcttttcctgatgcaggagggggccacccccagcgccgcgctggacatgaccgcgcgcaacatggaacctagcatgtacgccgccaaccggccgtttatcaataagctgatggactacctgcaccgcgcggcgtccatgaactcggactactttaccaatgccattttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgattcgctgctgcagccgccgcgggtcaagaacgccatggccaataacgggatagagagtttggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcggcggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcagagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacacaaacaataaattttgacgagcggtcgcggtggggcggtgatctgaagaccattctgcacaccaacatgcccaatgtgaacgagtacatgtttaccagcaagtttaaggcgcgggtgatggtggctagaaaaaaggcggaaggggctgatgcaaatgataggagcaaggatatcttagagtaccagtggtttgagtttaccctgcccgagggcaacttttccgagaccatgaccatagacctgatgaacaacgccatcttggaaaactacttgcaagtggggcggcaaaatggcgtgctggagagcgatattggagtcaagtttgacagcaggaatttcaagctgggctgggacccggtgaccaagctggtgatgccaggggtttacacctatgaggccttccacccggacgtggtgctgctgcctggctgcggggtggacttcaccgagagccgcctgagcaacctcctgggcattcgcaagaagcaacctttccaagagggcttcagaatcatgtatgaggatctagtagggggcaacatccccgccctcctgaatgtcaaggagtatctgaaggataaggaagaagctggcacagcagatgcaaataccattaaggctcagaatgatgcagtcccaagaggagataactatgcatcagcggcagaagccaaagcagcaggaaaagaaattgagttgaaggccattttgaaagatgattcaaacagaagctacaatgtgatcgagggaaccacagacaccctgtaccgcagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgcttccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttctaccgccgccgccgtgcgcaccaccgtcgacgatgtcatcgactcggtggtcgccgatgcgcgcaactatacccccgccccctccaccgtggacgcggtcatcgacagcgtggtggccgacgcgcgcgactatgccagacgcaagagccggcggcgacgaatcgccaggcgccaccggagtacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgccgccgcggccatttctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggccaggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggccaccgagcctcccaggaggcgaatatggggcgccgccagccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgattccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggttgagatggaagatgcaactcttccgccgcccaagggcgaaaagcggccgcggcccgacgcggaggagacgatcctgcaggtggacgagccgccctcgtacgaggaggccgtgaaggccggcatgcccaccacgcgtatcatcgcgccgctggccacgggtgtaatgaaacccgccacccttgacctgcctccaccacccacgcccgctccaccgaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagtctggcccccaagggcgcccccaactccagtcagtgggaacagaaaaaggccaatgctggagatcaaaaggaaacacatacttatggtgtagctcctatgggtggagaaaacattacaattagcggtttgcaaattggaacagatactacaaatggcaaacaagacccgatatatgctaataagctgtatcaaccagagcctcaagtaggagaagaaaactggcaggaaacagaagccttctatggaggaagggctcttaaaaaggaaaccaagatgaaaccatgctatggctcatttgccagacccacaaatgaaaaaggaggacaggcaaaactaagagaccctgaaaaaagtcaagaagattttgacatagacctagcattctttgatactccgggaggaactttaacaggtggtggaacggaatacaaagcagacattgttatgtgcactgaaaatgttaatcttgaaaccccggacacccacgtggtgtataaaccaggcaaagatgatgacagttcagaaatcaacttggttcagcagtccatgcccaacagacctaactacatcggcttcagggacaactttgtgggtctcatgtactacaacagcactggcaacatgggtgtgctggccggtcaggcttctcagttgaatgctgtggtcgacttgcaagacagaaacacagagctgtcttaccagctcttgctagattctctgggcgacagaaccaggtactttagcatgtggaactctgcggtggacagctatgatcccgatgtcaggatcattgagaatcacggtgtggaagatgaacttcccaactattgcttcccattggatgggtctggcaccaatgctgcttatgaaggtgtaaaagttaaaaatggagaagatggggatcaagagagcgaatgggaaaaagacaccaatgtggcagatcgaaaccaaatatgcaagggcaacatctacgccatggagatcaacctccaggccaacctgtggaagagttttctgtactcgaatgtggccctgtacctgcctgactcctacaagtacacgccggccaacgtcacgctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccctccctcggctcgggtttcgacccctactttgtctactcgggctccatcccctatctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaatgtggcccaatgcaacatgaccaaggactggttcctcgtccagatgctctcccactacaacatcggttaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactctggcttcaccggctacctcgcacccaccatgcgtcaggggcagccctaccccgccaacttcccctacccgctcatcggccagacagccgtgccatccgtcacccagaaaaagttcctctgcgacagggtcatgtggcgcatccccttctccagcaacttcatgtccatgggcgcccttaccgacctgggtcagaacatgctctacgccaactcggcccacgcgctcgacatgacctttgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctgaagcagatttacagcttcgagtacgaggccatgctacgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggagcagctctaccgcttcctcgcgcgccactccccttactttcgatcccaccgcgccgccatcgaacacgccaccgcttttgataaaatgaaacaactgcgtgtatctcaataaacagcacttttattttacatgcactggagtatatgcaagttatttaaaagtcaaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccgggccggagatcttgaaatcgcagttggggccggtgctttgcgcgcgcgagttgcggtacacggggttgcagcactggaacaccatcagactggggtacttcacactggcaagcacgctcttgtcgctgatctgatccttgtccaggtcctcggcgttgctcaggccgaacggggtcatcttgcacagctggcggcccaggaagggcacgctctgaggcttgtggttacactcgcagtgaacgggcattagcatcattcccgcgccgcgctgcatattcgggtagagggccttgacaaaggccgcgatctgcttgaaagcttgctgggccttggccccctcgctgaaaaacaggccgcagctcttcccgctgaactggttattcccgcatccggcatcctgcacgcagcagcgcgcgtcatggctggtcagttgcaccacgctccggccccagcggttctgggtcaccttggccttgctgggttgctccttcaacgcgcgctgcccgttctcactggtcacatccatctccaccacgtggtccttgtggatcatcaccgttccatgcagacacttgagctgaccttccacctcggtgcagccgtggtcccacagggcgcagccggtgcactcccagttcttgtgcgcgatcccgctgtggctgaagatgtaaccttgcaacatgcggcccattatggtgctaaaggttttctgagtggtgaaggtcagttgcagaccgcgggcctcctcgttcatccaggtctggcacatcttttggaagatctcggtctgctcgggcatgagcttgtaagcatcgcgcaggccgctgtcgacgcggtaacgttccatcagcacgttcatggtatccatgcccttctcccaggacgagaccagaggcagactcagggggttgcgcacgttcaggacaccgggtgtcgcgggctcgacgatgcgttttccgtccttgccttccttcaacagaaccggcggctggctgaatcccactcccacgatcacggcatcttcctggggcatctcttcgtcggggtctaccttggtcacatgcttggtcttcctggcttgcttcttttttggagggctgtccacgggaaccacgtcctcctcggaagacccggagcccacccgctgatactttcggcgcttggtgggcagaggaggtggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggaggagaccgacgctgggctcgagcatggctacctgggaggagaggaggatgtgctgctgaaacacctgcagcgccagtccatcatcctccgggacgccctggccgaccggagcgaaacccccctcagcgtcgaggagctaagtagggcctacgagctcaacctcttctcgccgcgcgtgccccccaaacgccagcccaacggcacatgcgagcccaacccgcgtctcaacttctaccccgtctttgcggtccccgaggccctcgccacctatcacatctttttcaagaaccaaaagatccccgtctcctgccgcgccaaccgcacccgcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacaggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagcttaacgacgagttggtgagctcttcaatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgatgcagtgagagaagcggtggacggctacgactgaatgtcccatgctgactcggctgagctcgctcggttgaggcatctggaccactgccgccgcctgcgctgcttcgcccgggagagctgcggactcatctactttgagtttcccgaggagcaccccaacggccctgcgcacggagtgcggatcaccgtagagggcaccgccgagtctcacctggtcaggttcttcacccagcaacccttcctggtcgagcgggaccggggcgccaccacctacaccgtctactgcatctgtcctaccccgaagttgcatgagaatttttgttgtactctgtgtgctgagtttaataaaagctaaactcctacaatactctgggatcccgtgtcgtcgcactcgcaacgagatcttcaacctcaccaaccagactgaggtaaaactcaactgcagaccggggggcaaatacatcctctggctctttgaaaacacttccttcgcagtctccaacgcctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagtcgctccagaaacatctaacctttttgatactaacactcctaaaaccggaggtgagctctgggttccctctttaacagaggggggtaaacatattgaagcggttgggtatttgattttaggggtggtcctgggtgggtgcatagcggtgctgtattaccttccttgctggatcgaaatcaaaatctttatctgctgggtcatacattgttgggaggaaccatgaaggggctcttgctgattatcctttccctggttgggggtgtactgtcatgccacgaacagccacgatgtaacatcaccacaggcaatgagaggagtgtgatatgcacagtagtcatcaaatgcgagcatgcatgtcctctcaacatcacattcaagaataagaccatgggaaattcatgggtgggcgattgggaaccaggagatgagcagaactacacggtcactgtccatggtagcgatgggaatcacactttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctttagtatggttcctgaagcacaagcctaggtatggaaatgaggagaaggaaaaattgctataaatctttttctcttcgcagaaccatgaatactttgaccagtgtcgtgctgctctctcttcttgtagcttttagtcaggcaggatttcatactatcaatgctacatggtgggctaatgtaactttagtgggaccctcagatacgccagtcacatggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgacgagcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaaatgagcataaacagggtgggcagaaacaggaggggcaaaaagagacaagtcaaaagaaagataatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgcgagcctgggtataagttagggtgtaagtgtgacaatcaaaacctaacgctaatcaatgtaactaaactttatgagggagtttactatggtactaatgacagaggtaacagcaaaagatacagattaaaagtaaacactactaattctcaaagtgtgaaaattcagccatacaacaggtctactactcctgatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactacttagcttctcttactgagactcagtcactttcatttcagaaccatgaaggctttcacagcttgcgttctgattagcatagtcacattagtatcagctgattacaaacaagttcaagttagcagaggaggaaatattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaggttagaacattttcatctagaaatcaaaaacatacaattgaagattctggagattatgaacaacaaaaaatatatctatataatctaacaataattgaagcgccaactactaaagcacccaccacagttagaacaaccacgcagacaactactagggaaacaacacatccaaccaccacagtcagtacaactcacactacacatctagacactacagtgcagaatactactttattgattgggtttttactaagaggaaatgaaagtactactgatcagacagaggctacctcaagtgccttcagcagcactgcaaatttaacttcgcttgcttcggtaaatgaaacgatcgtgccgatgatgtatggccaaccttactcaggtttggatattcaaattacttttctggttgtctgtgggatctttattcttgtggttcttttgtactttgtctgctgcaaagccagagaaaaatctaggaggcccatctacaggccagtaatcggggatcctcagcctctccaagtggaagggggtctaaggaatcttctcttctctttttcagtatggtgattcagccatgattcctaggttcttcctatttaacatcctcttctgtctattcaacgtgtgcgctgccttcgcggccgtctcgcacgcctcgcccgactgtcttgggcccttccccacctaccttctttttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatttgaccatgcagactctgctcatactgctatccttcctctcccctgccctcgctgatgatgattactctaagtgcaaatttgtggagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcttccacgccgccacccacaccgcctccccgcagaaatcagtttcccatgattcagtacttagaagagccccctccccggcccccttccactgttagctactttcacataaccggcggcgatgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctcctcaagaccctttgcggacttcgcgacctcctccccatgaactgattgattaaagcccaaaaaaccaatcaaaccccttcccattagccccaaataaacaatcattggaaataatcattcaataaagatcacttacttgaaatctgaaagtatgtctctggtgtagttgtttagcagcacctcggtaccctcctcccagctctggtactccagtccccggcgggcggcgaactttctccacaccttgaaagggatgtcaaattcctggtccacaattttcattgttttccctctcagatgtcaaagaggcttcgggtggaagatgacttcaaccccgtctacccctatgactacgcgcggaatcagaatatccccttcctcactcccccctttgtctcctccgatggattccaaaacttcccccctggtgtcctgtcactcaaattggctgacccaatcgctatcaccaatggtgatgtctcactcaaggtgggagggggacttactttacaagatggaaccggaaaactaactatcgacaccaagactcccttgcaagttgcaaataataaattagaacttgcgtttgatgcaccattgtatgaaaaaaatggaaaacttgctttaaaaacaggccatggattagctgttttaaccaaagacattggcataccagaattaattggatcccttgtgatcttaactggaaaaggaattgggacaggtactgttgcaggaggaggaactatagatgtaagactgggtgatgatggaggtttatcatttgataaaaagggtgatctagtagcctggaataaaaaaaatgacaggcgcactttgtggacaacacctgatccatccccaaactgcagagtatcagaagataaagattcaaaactaactttaattcttacaaaatgtggaagtcagatcctagcaagtttttcactgcttgtagtcaaagggacgtatgcaactgttgataaaaatacaactaataaacaatttagcattaaactactgtttgatgcaaatggaaagcttaaaagcgaatcaaaccttagtggttattggaactatagaagtgataatagtgttgttagtactccctatgacaatgcagtgcctttcatgccaaataccacggcttatcctgaaaataagaaaagttcggctaaaaaaactattgttggcaatgtctacctagaaggtaatgcgggtcaaccagtagccgttgctattagtttcaataaggaaactactgctgactattcaataacatttgactttgcgtggagcaaagcttatgaaacccctgtgccttttgacacctcctccatgacattctcatatattgcccaggaaaatcaagacaaaggcgaataaagtgttttgaaatgaacttatgtatctttattgatttttacaccagcacgggtagtcagtctcccaccaccagcccatttcacagtgtacacgattctctcagcacgggtggccttaaatagggaaatgttctgattagtgcgggaactggacttggggtctataatccacacagtttcctggcgagccaaacgggggtcggtgattgagatgaagccgtcctctgaaaagtcatccaagcgggcctcacagtccaaggtcacagtctagtggaatgagaagaacgcacagattcatattcggaaaacaggatgggtctgtgcctctccatcagcgccctcagcagtctctgccgccggggctcggtgcggctgctgcagatgggatcgggatcacaagtctctctgactatgatccccacagccttcagcatcagtctcctggtgcgtcgggcacagcaccgcatcctgatctcgctcatgttctcacagtaagtgcagcacataatcaccatgttattcagcagaccataattcagggtgctccagccaaaactcatgttggggatgatggaacccacgtgaccatcgtaccagatgcggcagtatatcaggtgcctgcccctcatgaacacactgcccatatacatgatctctttgggcatgtctctgttcacaatctgacggtaccatgggaaac

SEQ ID NO: 1436 - DNA, 32767 bp, Human adenovirus 68
catcatcaataatataccttatagatggaatggtgccaatatgcaaatgaggtaatttaaaaaagtgcgcgttgtgtggtgattggctgcggggtgaacggctaaaaggggcggggcaatgttgggaggttacgtgacttatgtgggaggagttatgttgcaagttatcgcggtaaaggtgacgtaaaacgaggtgtggtttggacacggaagtagacagttttcccacgcttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctcctccgcgccgcgagtcagttctgcgctttgaaaatgagacacctgcgattcctgccacaggagattatctccagcgagaccgggatcgaaatactggagtttgtggtaaataccctgatgggagatgacccggaaccgccagtgcagcctttcgatccacctacgctgcacgacctgtatgatttagaggtagacgggccggatgatcccaatgaggaagctgtaaatgggttttttactgattctatgctgctagctgccgatgaaggattggacataaaccctcctcctgagacccttgataccccaggggtggttgtggaaagcggcacaggtgggaaaaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggtcatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgagtcgccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattgcttattgggtggggacttggatatataagtaggagcagatctgtgtggttagctcatagcaacctgctgccatccatggaggtttgggctatcttggaagacctgagacagactaggctactgctagaaaacgcctcggacggagtctctggcttttggagattctggttcggaggtgatctagctaggctagtgtttaggataaaacaggactacagggaagaatttgaaaagttattggacgacagtccaggactttttgaagctcttaacttgggccatcaggctcattttaaggagaaggttttatcagttttagatttttctactcctggtagaactgctgctgctgtagcttttcttacttttatattggataaatggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacctgtttcctgaactgcgacgggtgcttactaggtctacgtccagtggacaggacaggggcattaagagggagaggaatcctagtgggaataatttaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaagtggccattaggaattatgctaagatatctctgaggcctgataaacagtatagaattactaagaagattaatattagaaatgcatgctacatattagggaatggggcagaggttataatagatacacaagataaagcagcttttagatgttgtatgatgggtatgtggccaggggttgtcggcatggaagcagtaacatttatgaatattaggtttagaggggatgggtataatggcattgtatttatggctaacactaagctgattctacatggttgtagcttttttggggttaataatacttgtgtagaagcttgggggcaagttagtgtgaggggttgtagtttttatgcatgctggattgcaacatcaggtagggtcaagagtcagttgtctgcgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagagaccttatcagatgctgacctgcgctggtggacattgcaatattcttgctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagtttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaaagtgagtagtggggcaagatgtggatggggactttgaggttggtaaggtggacagattgggtaaattttgttaatttctgtcttgcagctgccatgagtggaagcccttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcatcattggatgcagctgcagccgccgccgctactgctgcggccaacaccatccttggaatgggctattacggaagcatcgttgccaattccacttcctctaataacccttcaaccctggctgaggacaagctacttgttctcttggctcagcttgaggccttaacccaacgcttaggcgaactgtctaagcaggtggcccagttgcgtgagcaaactgagtctgctgttgccacagcaaagtctaaataaagatctcaaatcaataaataaagaaatacttgttataaaaacaaatgaatgtttatttgatttttcgcgcgcggtatgccctggaccatcggtctcgatcattgagaactcggtggattttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcagaaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctagcccgggagcatagtttccctcacatatttgcatttcccaggctttcagttccgagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagggatagaagctcctggagcgaggagaagtttttcaacggtttcagcccgtcagccatgggcattttggaaagagtctgttgcaagagctcgagccgatcccagagctcggtgatgtgctctatggcatctcgatccagcagacctcctcgtttcgcgggttgggacggctcctggagtagggaatcagacgatgggcgtccagcgctgctagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagtgggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttcaggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccataaagggcattggacagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcacccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaattggaagagatagtaggtctctggaatatgttaaaatgggcatgaggtaggcctacagagtcccttatgaagtgggcatatgactcttgcagcttggctaccagctcggcggtgacgagtacgtccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagagcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattctgaaaggctgagggacctctgctcggttattgataacctgagcggccaagacgatctcatcaaagccattgatgttgtgccccactatgtacagttctaagaatcgaggtgtgcccctgacatgaggcagcttcttgagttcttcaaaagtgaggtctgtagggtcagtgagagcatagtgttcgagggcccattcgtgcacgtgagggttcgctttgaggaaggaggaccagaggtccactgccagtgctgtttgtaactggtcccggtactgacgaaaatgctgcccgactgccatcttttctggggtgacgcaatagaaggtttgggggtcctgccgccagcgatcccacttgagttttatggccaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcatcgattcacgggatgcacctcatgaatgagttgtacctgacttcctttgacgagaaatttcagtggaaaattgaggcctggcgattgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggcgctaccaccgtgcccttgtttttccttttgggcggcggtggctctgttgcttcttgcatgtttagaagcggtgtcgagggcgcgcaccgggcggcaggggcggttcgggacccggcggcatggccggcagtggtacgtcggcgccgcgcgcgggtaggttctggtactgcgccctgagaagactcgcatgcgcgacgacgcggcggttgacatcctggatctgacgcctctgggtgaaagctaccggtcccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccaaaagacggatgagttcggcgatggtggtgcgcacctcgagctcgaaagcccctgggatttcttcctcaatctcttcttcttccactaacatctcttcctcttcaggtggggctgcaggaggagggggaactcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgggagggtgagacgatgctgctggtgatgaaattaaaataggcagttttgagacggcggatggtggctaggagcaccaggtctttgggtccggcttgttggatgcgcaggcgatgtgccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcatcaaagtccacgaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccgatgagaaagtgtggcggtggctggcggtacaggggccatcgctctgtagccggggcgccgggggcgaggtcttccagcatgagtcggtggtagccgtagatgtacctggacatccaggtgataccggaggcggtggtggatgcacgtgggaactcgcgcacgcggttccagatgttgcgcagcggcatgaagtagttcatggtaggcacggtttggcccgtgaggcgcgcacagtcgttgatgctctagacatacgggcaaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgttttttttttgtctttttcctggatgggagccagtgctgcgtcaagctttagaacgctcagttctcggggctgggagtggctcgcgcccgtagtctggagaatcaatcgccagggttgcgttgcggtgtgccccggttcgagtcttagcgcgtcggatcggccggtttccgcgacaagcgagggtttggcagccccgtcatttctaagaccccgccagccgacttctccagtttacgggagcgagccctctttttttttttgttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcgggacagcccgcctatgatctggacttggaagagggcgagggattggcgcgcctgggggctccatcgcccgagcggcacccacgggtgcaactaaaaaaggactctcgcgaggcgtacgtgccccaacagaacctattcagggacaggagcggcgaggagccagaggagatgcgagcatctcgatttaacgcgggtcgcgagctgcgccacggtctggatcgaagacgggtgctgcaagacgaggattttgaggtcgatgaagtgacagggatcagcccagctagggcacatgtggccgcggccaacctagtctcggcctacgagcagaccgtgaaggaggagcgcaacttccaaaaatctttcaacaaccatgtgcgcaccctgatcgcccgcgaggaagtgaccctgggtctgatgcacctgtgggacctgatggaggctatcacccagaaccccactagcaaacccctgacagctcagctgtttctggttgttcaacatagcagggacaacgaggcattcagggaggcgttgttaaacatcaccgagcccgatgggagatggctgtatgatctgattaacatcctgcaaagtattatagtgcaggaacgtagcctgggtttggctgagaaagtggcagctattaactactcggtcttgagtctgggcaaatactacgctcgcaagatctacaagaccccctacgtacccatagacaaggaggtgaagatagatgggttttacatgcgcatgactctcaaggtgctgactctgagcgacgatctgggggtgtatcgtaatgacaggatgcaccgcgcggtgagcgccagcaggaggcgcgagctgagcgacagagaacttatgcacagcttgcaaagagctctaacgggggccggaactgatggggagaactactttgacatgggagcggacttgcaatggcaacccagtcgcagggccatggaggctgcggggtgtgagcttccttacatagaagaggtggatgaagccgaggacgaggagggcgagtacttggaagactgatggcgcgacccatatttttgctagatggaacagcagcaggcaccggaccccgcaatgcgggcggcgctacagagccagccgtccggcattaactcctcggacgattggacccaggccatgcaacgcataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcagaccaacctggaccggatggtgaccgatgtgcgcgaggctgtgtctcagcgcgagcggttccaacgcgacgccaacttggggtcgttggtagcgctaaacgctttccttagcacccagcccgccaacgtgccccgtggtcagcaagactatacaaactttttaagtgcattaagactcatggtatctgaggtgccccagagcgaggtgtaccagtccgggccagattacttcttccagaccagcagacagggcttgcagacagtgaacctgacccaggctttcaagaacctgaagggtctgtggggagtgcacgccccagtaggagatcgcgcgaccgtgtctagtttgctgactcccaactcccgcctgctgctgctgctggtatcccccttcactgacagcggtagcatcgaccgcaactcctacttgggctacctgcttaacctgtatcgcgaggccatagggcagagccaggtggacgagcagacttatcaagaaatcacccaagtaagccgcgccctgggtcaggaagacacgggcggtttggaagccaccctgaacttcttactaaccaaccggtcgcagaagatccctcctcagtatgcgcttaccgccgaggaggagcggatcctaagatacgtgcaacagagcgttggactgttcctgatgcaggagggggcgacacctaccgccgcgctggatatgacagctcgaaacatggagcccagcatgtatgctagtaacaggcctttcattaacaaactgctggactacctgcacagggcggccgccatgaactctgattatttcaccaatgctattctgaacccacactggctgcctccacctggtttctacactggcgaatacgacatgcccgatcccaatgacgggttcctgtgggacgatgtggacagtagcatattttccccgcctccaggttatacggtttggaagaaggaagggggcgatagaaggcactcttccgtatcgttgcccggaacggctggtgctgccgcggccgtgcccgaagctgcgagtcctttccctagcttgtccttttcactaaacagcgttcgcagcagtgaactggggagaataaaccgcccgcgcttgatgggcgaggatgagtacttgaatgactctttgctgaggccagagagggaaaaaaacttccctaacaatggaatagagagcctggtggataagatgagtagatggaagacctatgcgcaggatcacagagacgagcccaggatcttgggggctacaagcagaccgagccgtagacgccagcgccacgacaggcagatgggtcttgtgtgggacgacgaggactctgccgatgacagcagcgtgttggacttgggtggaaaaggagttggcaacccgttcgctcatctgcgtccccgtttcggtcgcatgttgtaaaagtgaaagtaaaaataaaaaggcaactcaccaaggccatggcaaccgagcgtgcgttcgttcttttttttgttatctgtatctagtacgatgaggagacgagccgtgctaggcggagcggtggtgtatccggagggtcctcctccttcttacgagagcgtgatgcagcaacaggcggcgatgatacagcccccactggaggctcccttcgtaccccctcggtacctggcgcctacggaagggagaaatagcattcgttactcggagctgtcaccccagtacgataccaccaagttgtatctggtggacaacaagtcggcggacatcgcctccctgaactatcagaacgaccacagcaacttcctgaccacagtggtgcagaacaatgactttacccccactgaggctagcacccagaccattaactttgacgagcggtcgcggtggggcggtcagctgaagaccattatgcacaccaacatgcccaacgtgaacgagtacatgttcagcaacaagtttaaggcgagggtgatggtatctaggaaggctcctgaaggtgttacagtaaatgatcataaagatgatattttgaaatatgagtggtttgagttcactttaccagaaggtaacttctcagctaccatgaccatcgacctgatgaacaatgccatcattgacaactacctgaaaattggcagacagaatggagtgctggaaagtgacattggtgttaagtttgacactagaaacttcaggctcgggtgggaccccgaaactaagttgattatgccaggggtctacacttatgaggcattccatcctgacattgttttgttgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaggcgaaaaggcggtggttaaaacaaccacagtggctgttgcagaggaaaccagtgaagatgataatataactagaggagatacttatataactgaaaaaaaaaaacgtgaagctgcagctgcagaactattacttatgtctgaagttaaaaaagagttaaagatccaacctttagaaaaagacagcaagaatagaagctacaatgtcttggaagacaaaatcaacacagcctaccgcagctggtacctgtcctacaattatggtaaccctgagaaaggaataaggtcctggacactgctcaccacttcggatgtcacctgtggagccgagcaggtctactggtcgctccccgacatgatgcaagaccccatcaccttccgctcctcgagacaagtcaacaactacccagtagtgggtgcagagcttatgcccgtcttctcaaagagtttctacaatgagcaagccgtgtactctcagcagctccgacagtccacctcgctcacgcacgtcttcaaccgcttccctgagaaccagatcctcatccgcccgccggcgcccacaattaccaccatcagtgaaaacgttcctgctctcacagatcacgggaccctgccgttacgcagcagtatccggggagtccagcgcgtgaccgttactgacgccagacgtcgcacctgtccctacgtttacaaggccctgggcatagtcgcgccgcgcgttctttcaagccgcactttctaaaaaaaaaaaaaatgtccattctcatctcgcccagtaataataccggttggggactgcatgcgcccaccaagatgtacggaggcgcccgcaaacgctctacccagcaccccgtgcgcgttcgcggtcatttccgcgctccctggggcgccctcaagggccgtacccgcactcggaccacggtcgatgatgtgatcgaccaggtggttgccgatgctcgtaattatactcctactgcgcctacatctactgtggatgcagttattgacagtgtggtggcagacgcccgcgcctatgctcgccggaaaagccgaaggaggcgcatcgccaggcgccacagggctactcccgccatgcgagctgcaaaagctattctgcggagggccaaacgtgtggggcgaagagccatgcttagagcggccagacgcgcggcttctggtgctagcagcggcaggtcccgcaggcgcgcggccacggcggcagcagcggccattgccaacatggtccaaccgcgaagaggcaatgtgtattgggtgcgcgatgccgctaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccaccgatgaaggatgaaaaaaagccccgcaaaatcaagcgggtcaaaaaggacaaaaaagaagaagatggcgatgatgggctggtagagtttgtgcgcgagttcgccccaagacggcgcgtgcagtggcgcggtcgaaaagtgcgccaagtgcttagacccgggaccactgtggtctttacacctggcgagcgttccagcactacttttaaacggtcctatgatgaggtgtatggggatgacgatattcttgagcaggcggcagaccgccttggcgagtttgcttatggcaagcgcacaagatccagtcccaaagaggaggcggtgtctattcccttggatcatggaaatcccacccccagcctcaaaccagtcaccctgcagcaagtgctgcccgtacccgcgagcagaggcgtaaagcgcgagggtgaggacctatatcccaccatgcagctaatggtgcccaagcgccaaagattagaagatgtactggagaaaatgaaagtggatgccgatatccagcctgaggtcaaagtgagacccatcaaggaagtggcgccaggtttgggagtacaaacctttgacatcaagattcccactgagtccatggaagtgcagaccgaacctgcaaaacccacaaccacctcaattgaggtgcagacggaaccctggatgcacgcgcccgttgccgcccccagcaccactagaagatcacgtcgaaagtatggcccagcaagtctgataatgcccaactatgctctgcacccatccatcattcccaccccgggttacagaggcactcgctactatcgaagtcggagcaacacctcacgccgccgcaaactacctgcaagtcgcactcgccgtcgccgccgccgcaccactgccagcaaattaactcccaccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcaagcgattagggggtggctttctgccagctcttatacccatcatcgccgcggcgatcggggcgataccaggcatagcttccgtggcggttcaggcctcgcagcgccactaacaatggaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggaacagtatctggagcgggcttaaaaattttggctcgaccataaaaacctatgggaataaagcttggaacagcagcacagggcaggctctgagaaataagcttaaggagcagaacttccaacagaaggtggttgatggtatcgcctctggtattaacggcgtagtggatctggccaaccaggctgtgcagaaacagataaacagccgcctggacccgccgcccgcaaccgctggtgaaatggaagtggaggaagagcttcctccgctggaaaagcggggcgacaagcgaccgcgtcccgagctggagcagacgttggtgacgcgcgcagacgagcccccttcatacgaggaggcagtaaagctcggaatgcccactaccaggcctgtagctcacatggctaccggggtgatgaaaccttctcagtcgcatcggcccgtcaccttggacttgcctcctccccctgcttctgcggcgcctgttcccaaacctgtcgctaccagaaagcccaccgccatacagcccgtcgccgtagccagaccgcgtcctgggggcacaccgcgcccgaaagcaaactggcagagtactctgaacagcatcgtgggtctgggcgtgcaaagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcttacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgcctgatgctgcgctttgtgcccgttgaccgggaagacaatacctactcttacaaagttcgctacacgctggctgtaggcgacaacagagtgcttgacatggccagcacattctttgacattcggggggtgctcgatagaggtcctagcttcaagccatattccggcacagcttacaattcactggctcctaagggcgcgcccaatacatctcagtggatagttacaacaaatgcggaccaaactaccaccaccaccacaaacacattcggcattgctgccatgaagggagacaatattactaaagaaggtttacaaattgggaaagacattaccactaccgaaggagaagaaaagcccatttatgccgataaaacatatcagccagagcctcaagttggagaagaatcatggactgatactgatggaacaaatgaaaagtttggtggtagagcccttaaaccagctaccaacatgaagccgtgctacgggtcttttgcaagacctacaaacataaaagggggtcaggctaaaaacagaaaagtaaaaccaacaaccgaaggaggggttgaaactgaagaaccagatattgatatggaatttttcgatggtagagatgctgttgcaggagctttagcgcctgaaattgtgctttatacggaaaatgtaaatttggaaactccagacagtcatgtggtatataagccaggaacttctgataactctcatgcaaatttgggtcaacaagccatgcctaacagacccaattacattggcttcagggataactttgtgggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttatgatcccgatgttcgcattattgaaaatcatggcatcgaggatgaactgcctaattactgttttcctctggatggcataggaccagggcacacatatcaaggcattaaagttaaaaccgatgacactaatggatgggaaaaagatgctaatgttgctacagctaatgaaatagccataggcaacaacctggctatggaaattaatattcaagctaacctttggagaaattttctctactccaatgtggctttgtaccttccagatgtttacaagtacacgccacctaacattactctgcccgctaacaccaacacctatgagtacatgaacgggcgagtggtatccccatctctggttgattcatacatcaacattggcgccagatggtctcttgacccaatggacaatgtaaatccattcaaccaccaccgcaatgctggtttgcgctacaggtccatgcttctgggaaatggtcgttatgtgcctttccacatacaagtgcctcagaaattctttgctgttaaaaacctgctgcttctcccaggctcctacacttatgagtggaacttcagaaaggatgtgaacatggtcctgcaaagttcccttggaaatgacctcagaacagatggtgctaccataagttttaccagcatcaacctctatgccaccttcttccccatggctcacaacaccgcttcaacccttgaagccatgctgcgcaacgataccaatgatcagtcattcaacgactacctctctgcagctaacatgctttaccccatccctgccaatgcaaccaatattcccatttccattccttctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagcccaaatgagtttgaaatcaagcgcactgtggacggggaaggatacaatgtggcccaatgcaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttacagacctgggacagaacctgctctatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggttgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgccccatgaacggaaaccccaccatgaagttgctgactggggtgtccaacagcatgctccaatctccccaagtccagcccaccctgcgccgcaaccaggaggcgctatatcgcttcctaaacacccattcatcttactttcgttctcaccgcgcacgcatcgaaagggccaccgcgtttgaccgtatggatatgcaataagtcatgtaaaaccgtgttcaataaaaagcactttatttttacatgcactaaggctctggttttttgctcattcgttttcatcattcactcagaaatcaaatgggttctggcgggagtcagagtggcccgcgggcagggatacgttgcggaactgtaacctgttctgccacttgaactcggggatcaccagcttgggaactggaatctcgggaaatgtgtcttgccacaactttctggtcagttgcatggcgccaagcaggtcaggagcagagatcttgaaatcacagttggggccggcattctgaacacgggagttgcggtacactggattgcaacactggaacaccatcaaggctgggtgtctcacgcttgccagcacggtcgggtcactgatggtagtcacatccaagtcttcagcattggccatcccaaagggggtcatcttacaggtctgcctgcccatcacgggagcgcagcctggcttgtggttgcaatcgcaatgaatggggatcaacatcatcctggcttggtcgggggttatccctggatacacggccttcatgaaggcttcgtactgcttgaaagcttcctgagccttacttccctcggtgtagaacatcccacaggacttgctggaaaattggttagtagcacagttggcatcattcacacagcagcgggcatcgttgttggccaactggaccacatttctgccccagcggttctgggtgatcttggctctgtctgggttctccttcatagcgcgctgcccgttctcgctcgccacatccatctcgataatgtggtccttctggatcatgatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcgggatgccacggtgctcctcgttcacatactggtggcagatacgcttgtactgctcgtgctgctctggcatcagcttaaaagaggttctcaggtcattatccagcctatacctttccattagcacagccatcacttccatgcctttctcccaggcagataccaggggcaagctcaaaggattcctaacagcaatagaagtagctcctttagctatagggtcattcttgtcgatcttctcaacacttcttttgccatccttctcaatgatgcgcaccggggggtagctgaagcccacggccaccaactgagcctgttctctttcttcttcgctgtcctggctgatgtcttgcagagggacatgcttggtcttcctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtccggccttggaggctgatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcaatcaccaggaggctggcctcggggatcatgttgccgactacctcaccgggcttgggggggaggacgtgctcctcaaacatctagcaaggcagtcgatcatagttaaagacgcactactcaacctcaccgaagtgcccatcagtgtggaagagcttagccgcgcctacgagctgaacctcttttcgcctcagataccccccaagcggcagccaaacggcacctgcgaggccaaccctcgactcaacttctatccagcttttactgtccccgaagtactggccacctaccacatcttttttaagaaccaaaagattccagtctcctgccgcgccaaccgcacccgcgcagatgcccttctcaacttgggtccgggagctcgcttacctgatatagctgccttggaagaggttccaaagatctttgagggtttgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaaggcgcaagcttatgatggctgtagtgctagtaactgttgagctggagtgtctgcgccgcttttttaccgaccccgagaccctgcgcaagctagaggagaacctgcactataccttcagacatggcttcgtgcgccaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaacctcaaagagctggacaagctcttgcagagatccctgaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgtcacctgctgtgcgctgccctccgactttgtgcctctcacctaccgcgagtgcccaccgccattatggagccactgctacctgttccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccagggcagagtctgaaactgacaccggggctgtggacctccgcatacctgcgcaagtttcatcccgaggactatcacccctatgagatcaggttctatgaggaccagtcacatcctcccaaagtcgagctctcagcctgcgtcatcacccagggggcaattctggcccaattgcaagccatccaaaaatcccgccaagaatttctgttgaaaaagggaagcggggtctaccttgacccccagaccggtgaggagctcaacacaaagttcccccaggatgtcccatcgccgaggaagcaagaagctgaaggtgcagctgtcgcccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaacggtaagaaggagcgacagggatacaagtcctggcgtggacataaaaacgctatcatctcctgcttgcatgaatgcgggggcaacatatccttcacccggcgatacctgctcttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatccacaacaagtgcaacaggaggaggactgaggatcacagcgaacgagccagcgcagaccagagagctgaggaaccggatctttccaaccctctatgccatcttccagcagagtcgggggcaagagcaggaattgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattcgaaaacggcgggaatcacgtcacccttggcacctgtcctttgccctcgtcatgagtaaagagattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgaatcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgtttcgcccgggaactcaccgagttcatctacttcgaactctccgaggagcaccctcagggtccggcccacggagtgcggattaccatcgaagggggaatagactctcgcctgcatcgaatcttctcccagcgacccgtgctgattgagcgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacattaggagtagttgcgggtgggcttgtgctgatcctttgctacctatacacaccttgctgtgcatatttagtcatattgcgctgttggtttaaaaaatgggggccatactagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcagatccgttgaaattacacataataacaaaacatggaacaataccttatccaccacatgggagccaggagttcccgagtggtatactgtctctgtccgaggtcctgacggttccatccgcattagtaacaacacttttattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaataaggaaaaagagaaaatgccttaacctttttactcataccttttctttacagcatggcttctgttacagctctaattattgccagcattgtcactgtcgctcacgggcaaacaattgtccatattaccttaggacataatcacacccttgtagggcccccaattacttcagaggttatttggaccaaacttggaagtgttgattattttgatataatttgcaacaaaactaaaccaatatttgtaatctgcaacagacaaaatctcacgttaattaatgtcagcaaaatttataacggttactattatggttatgacagatccagtagtcaatataaaaattacttagttcgcataactcagcccaaatcaacagtgccaactatgacaataattaaaatggctaataaagcattagaaaattttacattaccaacaacgcccaatgaaaaaaacattccaaattcaatgattgcaattattgtggcggtggcattgggaatggcactaataataatatgcatgttcctatatgcttgttgctataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaacaaggctatgtcacttggtggagaatatatgataatggagggttcgctagaccatgtgatcagcctggtacaaaattttcatgcaacggaaaagacttgaccataattaacataacatcaaatgagcaaggcttctattatggaaccaactataaagatagtttagattacaacattattgtagtgccagccaccacttctgctccccgcaaatccactttctctagcagcagtgccaaagcaagcacaattcctaaaacagcttctgctatgttaaagcttcaaaaaatcgctttaagtaattccacagccgctcccaatacaattcctaaatcaacaattggcatcattactgctgtggtagtgggattaattattatgtttttgtgcataatgtactacgtctgctgctatagaaaacatgaacaaaaaggtgatgcattactaaattttgacatttaattttttatagaattatgatattgtttcaatcaaataccactaacactatcaatgtgcagactactttaaatcatgacatggaaaaccacactacctcctatgcatacacaaacattcagcctaaatacgctatgcaactagaaatcaccatactaattgtaattggaattcttatactatctgttattctttattttatattctgccgtcaaatacccaatgttcatagaaattctaaaagacgtcccatctattctcctatgattagtcgtccccatatggctctgaatgaaatctaagatctttttttttctcttacagtatggtgaacaccaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgtctggttattaattttttccaactggtagactggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccagatgaacatatcccactacaccacatacaacaaccactagcactggtagagtatgaaaatgagccacaaccttcactgcctcctgccattagttacttcaacctaaccggcggagatgactgaaatactcaccacctccaattccgccgaggatctgcttgatatggacggccgcgcctcagaacagcgactcgcccaactacgcatacgccagcagcaggaacgtgccgccaaggagctcagggatgctattgaaattcaccaatgcaaaaaaggcatattttgtttggtaaaacaagccaagatatcctacgagattaccaatactgaccatcgcctctcatacgagctcggaccgcagcggcaaaaattcacttgtatggtgggaatcaaccccataatcatcacccagcaagctggagataccaagggttgcatccactgttcctgcagttccaccgagtgcatctacaccctgctgaagaccctctgcggccttcgagacctcctacccatgaactaatcaacccagcccctcacttaccaattacataaagccaataaaaacacttacttgaaatcagaaataaggtttctgtctacgttgtttccaagcagcacctcacttccctcttcccaactctggtactctaagcctcggcgggtggcatacttcctccacactttgaaagggatgtcaaattttagttcctcttctttgcccacaatcttcatttctttatccccagatggccaaacgagctcggctaagcagctccttcaatccggtctacccctatgaagatgaaagcagctcacaacacccctttataaaccctggtttcatttcctcaaatggttttgcacaaagcccagatggagttctaactcttaaatgtgttaatccgctcactaccgccagcggacccctccaacttaaagttggaagcagtcttacagtagatactatcgatgggtctttggaggaaaatataactgccgcagcgccactcactaaaactaaccactccataggtttatcaataggatctggcttacaaacaaaggatgataaactttgtttatcgctgggagatgggttggtaacaaaggatgataaactatgtttatcgctgggagatgggttaataacaaaaaatgatgtactatgtgccaaactaggacatggtcttgtgtttgactcttccaatgctatcaccatagaaaacaacaccttgtggacaggcgcaaaaccaagcgccaactgtgtaattaaagagggagaagattccccagactgtaagctcactttagttctagttaagaatggaggactgataaatggatacataacattaatgggagcctcagaatatactaacaccttgtttaaaaacaatcaagttacaatcgatgtaaacctcgcatttgataatactggccaaattatcacttacctatcatcccttaaaagtaacctgaactttaaagacaaccaaaacatgactactggaaccataaccagtgccaaaggcttcatgcccagcaccaccgcctatccatttataacatacgccactgagaccctaaatgaagattacatttatggagagtgttactacaaatctaccaatggaactctctttccactaaaagttactgtcacactaaacagacgtatgtcagcttctggaatggcctatgctatgaatttttcatggtctctaaatgcagaggaagccccggaaactaccgaagtcactctcattacctcccccttctttttttcttatatcagagaagatgactgacaacaaaaaaaaaataaagatcaacttttttattgaaaatcagtttacaagattcgagtagttattttgcccccctcttcccattttatagaatacacaattctctccccacgcacagctttgaacatttgaattccattagagatagacatagttttagattccacattccacacagtttcagagcgggccaatcttggatcagtgatagatataaatccatcggaacagtctttcaaggtgg

SEQ ID NO: 1437 - DNA, 32767 bp, Human adenovirus 67
catcatcaataatataccccacaaagtaaacaaaagttaatatgcaaatgagcttttgaatttagggcggggccgtcgctgattggacgagagaagacgatgcaaatgacgtcacgacgcacggctaacggtcgccgcggaggcgtggcctaggccggaagcaagtcgcggggctgatgacgtataaaaaagcggactttagacccggaaacggccgattttcccgcggccacgcccggatatgaggtaattctgggcggatgcaagtgaaattaggccattttggcgcgaaaactgaatgaggaagtgaaaagtgaaaaataccgggcccgcccagggcggaatatttaccgagggccgagagactttgaccgattacgtgggggtttcgattgcggtgttttttcgcgaatatccgcgtccgtgtcaaagtccggtgtttatgtcacagatcagctgatccacagggtatttaaaccagtcgagcccgtcaagaggccactcttgagtgccagcgagtagagatttctctgagctccgctcccagagtctgagaaaaatgagacacctgcgccttctaccttcaactgtgcccggtgagctggctgtgcttatgctggaggactttgtggatacagtattggaggatgaactgcatccaagtccgttcgagctgggacccacacttcaggacctctatgatctggaggtagatgcccatgatgacgaccctaacgaagaggctgtgaatttaatatttccagaatctatgattctccaggctgacatagccagcgaagctatagttactccacttcataccccgactctgccaccaatacctgaattggaagaggaggacgagatagacctccggtgctacgaggaaggttttcctcccagcgattcagaggacgaacagggtgagcgagagatggctattctatcggactttgcttgtgtgattgtggaggagcaagatgtgattgaaaaatctaccgagccagtacaaggctgtagaaactgccaataccaccgggataagtccggagatccaaacgcctcctgcgctctgtgctatatgaaacagactttcagctttatttacagtaagtggagtgaatgtgagagaggttgagtgcttaacacataactgtgtaatgcttgaacagctgtgctaagtgtggtttattttgttactaggtccggtgtcagaggatgagtcatcgccctcagaagaagaccacccgtctccccctgagctgtcaggcgaaacgcccctgcaagtgcacagacccaccccagtcagacccagtggcgagaggcgagcagctgttgaaaaaattgaggacttgttgcatgacatgggtggggatgaacctttggacctgagcttgaaacgccccaggaactaggcgcagatgcgcttagtcatgtgtaaataaagttgtacaataaaagtatatgtgacgcatgcaaggtgtggtttatgactcatgggcggggcttagtcctatataagtggtaacacctgggcactcaggcacagaccttcagggagctcctgatggaggtgtggactatccttgcggactttaacaagacacgccggcttgtagaggatagttcagacgggtgctccggtttctggagacactggtttggaactcctctagctcgcctggtgtacactgttaagaaggattatcaggacgaatttgaaaatctttttgctgactgttctggccttcttgattcactgaatctcggccaccaggctctattccaggaaagggtcctccacagccttgatttttccagcccagggcgcactacagccggtgttgcttttgtggtgtttctggttgacaaatggagccagcaaacccacctaaccagggattacatcctggacttcacggccatgcacctgtggaaggcctgggtcaggcagcggggacagagaatcttgaactactggcttctacagccagcagctccgggtcttcttcgtctacacagacaaacatccatgttggaggaagaaatgaggcaggccatggacgagaacccgaggagcggtctggaccctccgtcggaagaggagctggattgaatcaggtatccagcctctatccagagcttagcaaggtgctgacatccatggccaggggagtgaagagggagaggagcgatgggggcaataccgggatgatgaccgagctgacggccagcctgatgaatcgcaagcgtccagagcgcattacctggcacgagctacagatggagtgcagggatgaggtgggcctgatgcaggataaatatggcctggagcagataaaaacccattggttgaacccagatgaggattgggaggaggccattaagaaatatgccaagatagccctgcgcccagattgcaagtacagggtgaccaagacggtgaatatcagacatgcctgctacatctcgggtaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgatgttcatggccaacagccacatgaccctgcatggctgcagtttctttggcttcaacaatatgtgcgcagaggtctggggcgctgctaagatcaggggatgtaagttttatggctgctggatgggcgtggtcggaagacccaagagcgagatgtctgtgaagcagtgtgtgtttgagaaatgctacctgggagtctctaccgagggcaatgctagagtaagacactgctcttccctggagacgggctgcttctgcctggtgaagggcacagcctctctgaagcataatatggtgaagggctgcacggatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggcgccagaaggggcaccttccagccgtaccagtgcaaccttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggttgagtgagtagtgggcgtggctaaggtgactataaaggcgggtgtcttacgagggtctttttgcttttctgcagacatcatgaacgggaccggcggggccttcgaaggggggcttttcagcccttatttgacaacccgcctgccgggatgggccggagttcgtcagaatgtgatgggatcgacggtggacgggcgcccagtgcttccagcaaattcctcgaccatgacctatgcgaccgtggggagctcgtcgctcgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagctctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtgtagtttggcctggatcttgaggttggcgatgttgccacccagatcccgccgtgggttcatgttgtgcaggaccaccagaacggtgtagcccgtgcacttggggaacttgtcatgcaacttggaagggaatgcgtggaagaatttggagacgcccttgtgcccacccaggttttccatgcactcatccatgatgatggcgatgggcccgtgggctgcggctttggcaaagacgtttctggggtcagagacatcgtaattatgctcctgggtgagatcatcataagacattttaatgaacttggggcggagggtgccagattgtgggacgatggttccctcgggccccggggcaaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggagatgcagctgccgtcgtcccggaggaggggggccacctcgttgagcatgtccctgacttggaggttttcccggacgagctcgccgaggaggcggtccccgcccagcgagagcagctcttgcagggaagcaaagtttttcaggggcttgagcccgtcggccatgggcatcttggcgagggtctgcgagaggagctggaggcggtcccatagctcggtgacgtgctctacggcatctcgatccagcagacttcctcgtttcgggggttgggacgactgcgactgtagggcacgagacgatgggcgtccagcgctgccagcgtcatgtccttccagggtctcagggtccgcgtgagcgtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcacggagcttgcccttggaagagcgcccgcaggcgggacagaggagggattgcagggcgtagagcttgggtgcgagaaagacggactcgggggcgaaagcatccgctccgcagtgggcgcagacggtctcgcactccacgagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgttcgtcctcactctcttccgcgtcgctgtccacgagcgccagctgttggggtaggtattccctctcaagagcgggcatgacctcggcactcaggttgtcagtttctagaaacgaggaggatttgatattggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacactggtggccacctcgccgcgcaggggctcgttggtccagcagagtctgccgcccttgcgcgagcagaaagggggcagcacatccaggaggtgctcgtcaggggggtccgcatcgatggtgaagatgcccggacagagttccttgtcaaaatagtctatttttgaggatgcatcatccaaggccatctgccactcgcgggcggccattgctcgctcgtaggggttgagtggcggaccccagggcatgggatgcgtgagcgcggaggcgtacatgccgcagatgtcatagacatagatgggctccgagaggatgccgatgtaggtgggataacagcgccccccgcggatgctggcgcgcacatagtcatacaactcgtgcgagggggccaagaatgcgggaccgagattggtgcgctggggctgctcggcgcggaagacgatctggcgaaagatggcatgcgagtttgaggagatggtgggccgttggaagatgttaaagtgggcgtgcggcagtcggaccgagtcgcggatgaagtgcgcgtaggagtcttgcagcttggcgacgagctcggcggtgacaaggacgtccatggcgcagtagtccagcgtttcgcggatgatgtcataacccgtctctcctttcttctcccacagctcgcggttgagggcgtactcctcgtcatccttccagtactcccggagcggaaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttgacctgcatgaaggaagcccagagctcgcgggccatgagggtctggagctcgtcgcgaaagaggcggaactgctggcccacggccatcttttcaggggtgacgcagtagaaggtgagggggtcccgctcccagcgatcccagcgtaagcgcacggctagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatatcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgtttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgtgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcctgcgcgctcgacggtggcggcgaggtcattggagatgcgacccatgagctgcgagaaggcgcccaggccgctttcgttccagacgcggctgtagaccacgtccccgtcggcgtcgcgtgcgcgcatgaccacctgcgcgaggttgagctccacgtgccgcgcgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagtctctcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccatgagcgaccagttgacggtctgcaggccgggttgcacgacctccgagtacctgagccgcgagaaggcgcgcgagtcgaagacgtagtcgttgcaggtgcgcacgaggtactggtatccgactaggaagtgcggcggcggctggcgatagagcggccagcgctgggtggccggcgcgcccggcgccaggtcctccagcatgaggcggtggtagccgtagaggtagcgggacatccaggtgatgccggcggcggtggtggaggcgcgcgggaactcgcggacgcggttccagatgttgcgcagcggcaggaaataatccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgaggggggtcgctagacttgaaagcggccgaaaaccccgccgggtagtggctcgcgcccgtagtctggagaagcatcgccagggttgagtcgcggcagaacccggttcgaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcaccggcgctagccagccacagccacagacagagatggacttggaagagggcgaagggctggcgagactgggggcgccgtccccggagcgacacccccgcgtgcagctgcagaaggacgtgcgcccggcgtacgtgcctccgcagaacctgttcagggaccgcagcggggaggagcccgaggagatgcgcgactgccggtttcgggcgggcagggagctgcgcgagggcctggaccgccagcgagtgctgcgcgacgaggatttcgagccgaacgagcatacggggatcagccccgcgcgcgcgcacgtggcggcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcaaagcatcgtagtgcaggagcgcagcctgagcctggccgagaaggtggcggcgatcaactactcggtgcttagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcgctggtagggggcgcctctggcggcgaggagtcctacttcgacatgggggcggacctgcattggcagccgagccggcgcgccttggaggccgcctacggtccagaggacttggatgaggaagaggaagaggaggaggatgcacccgttgcggggtactgacgcctccgtgatgtgtttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgtgggcgatcgtgaacgcgctggcggagaacaaggccatccgtcccgacgaggccgggctggtgtacaacgccctgctggagcgcgtgggccgctacaacagcacgaacgtgcagtccaacctggaccggctcgtgacggacgtgcgcgaggccgtggctcagcgcgagcggttcaagaacgagggcctgggctcgctggtggcgctgaacgccttcctggcgacgcagccggcgaacgtgccgcgcgggcaggacgattataccaactttatcagtgcgctgcggctgatggtgaccgaggttccccagagcgaggtgtaccagtcgggcccggactactttttccagactagcagacagggcctgcagacggtgaacctgagccaggctttcaagaatctgcgcgggctgtggggcgtgcaggcgcccgtgggcgaccggtcgacggtgagcagcttgctgacgcccaactcgcggctgttgctcctgctgatcgcgcccttcacagacagcggcagcgtgaaccgcaactcgtacctgggtcacctgctgacgctgtaccgcgaggccataggccaggcgcaggtggacgagcagaccttccaggaaatcacgagcgtgagccgcgcgctggggcagaacgacaccgacagtctgagggccaccctgaacttcttgctgaccaatagacagcagaagatcccggcgcagtacgcgctatcggccgaggaggagcgcatcctgagatatgtgcaacagagcgtagggctgttcctaatgcaggagggggccacccccagcgccgcgctggacatgaccgcgcgcaacatggaacctagcatgtacgccgccaaccggccgttcatcaataagctgatggactacttgcaccgcgcggcggccatgaactcggactactttacaaacgccattctgaacccgcactggctcccgccgccggggttctacacgggcgagtacgacatgcccgaccccaacgacgggttcctgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagaaagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggaggcggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaagcacccagagaatgtagctaaagaggatttgagtcaggatatcttagaatataagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacctacgaggccttccatccggacgtggtgctgctgccgggctgcggggtggactttaccgagagccgcctgagcaacctcctgggcattcgcaagaagcaacctttccaagagggcttcaggatcatgtatgaggatctagaagggggcaacatccccgcactccttgatgtggccaagtacttggaaagcaagaagaaggtagaggaagcaattaagaaggccgctgaaaccaatggaacccctagaggagacagtgatgttgcaagagaggtggaaaaggcagctcaaactcagcttgtcattgagcccatcaagcaagatgatagcaagagaagttacaacctcatcgagggaaccatggacacgctgtaccgcagctggtacctgtcctatacctacggggaccccgagaagggggtgcagtcgtggacgctgctcaccaccccggacgtcacctgcggcgcggagcaagtctactggtcgctgccggatctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctatgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgccgccgccgtgcgcaccaccgtcgacgacgtcatcgactcggtggtcgccgacgcgcgcaactacacccccgccccctccaccgtggacgcggtcatcgacagcgtggtggccgacgcgcgcgactatgccagacgcaagagccggcggcgacggatagccaggcgccaccggagtacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgtcccaggcggttctgctcccgagccgcggggtcaagcgcgagggcgaaagcatgtaccccaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcagaccgacccctggctcccagcctccaccgctaccgcctccaattctaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgcggcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggaactatgggaacaaggcctggaatagtagcacggggcagttgttaagggaaaagctcaaagaccataacttccagcagaaggtggtggacgggctggcctcgggcattaacggggtggtggacatcgcgaaccaggccgtgcagcgcgagataaacagccgcctggacccgcggccgcccacggtggttgagatggaagatgcaactcttccgccgcccaagggcgagaagcggccgcggcccgacgcggaggagacgatcctgcaggttgacgagccgccctcgtacgaggaggccgtgaaggccggcatgcccaccacgcgcatcatcgcgccgctggccacgggtgtaatgaaacccgccacccttgatctgcctccaccacccacgcccgctccaccgaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagtctggcccccaagggtgcccccaactccagccagtggcttgcaaaagacaccaatgctggcgatcaagcattaaaaacccacacacatggcgtagctgctatggggggaacagatatcacagcaaagggtttgcaaattggtgttgatacgactgaaaacaagaatgagcctatttatgcaaatgaaatataccagccagaacctcaggtaggagaggaaaacttgcaagatgttgaaaacttttatggaggcagagctcttaaaaaagaaaccaaaatgaaaccttgctatggctcgtttgccagacccacaaatgaaaaaggcggtcaagccaaatttttaactgacggcgatggtcagctaactaaaaatcatgatatcacaatgaatttctttgacactcctggaggaacagttggtcaggatactgaacttgaagcagacattgttatgtatgctgagaatgtgcatctggaaactccagacacgcatgtggtgtacaaaccaggaacttctgatgagagttcagaagcaaatttggttcagcagtccatgccaaacaggcccaactacatcggcttcagggacaactttgtgggtctcatgtactataacagcactggcaacatgggtgtgctggctggtcaagcatctcagttgaatgctgtggtcgacttgcaagacagaaacacagagctgtcttaccagctcttgctagattctctgggtgacagaaccagatactttagcatgtggaactctgcagtggacagttatgatcctgatgtcaggattattgaaaatcacggtgtggaagatgaacttccaaactattgcttcccattggatggagctggcactaatgctacctaccaaggtgtaaaagttaaaaatggccaagatggagatgtaaacgcagattgggaaaaagatccaaatcttgcttcacgaaaccaaatatgcaagggtaacatcttcgccatggagatcaacctccaggccaacctgtggaagagttttctgtactcgaatgtggccctgtacctgcccgactcctacaagtacacgccggccaacatcacgctgcccaccaacaccaacacctacgagtacatgaacggccgcgtggtggcaccctcgctggtggatgcctatgtcaacatcggtgcccgctggtcgctggaccccatggacaatgtcaaccccttcaaccaccaccgcaacgcgggtctgcgctaccgctccatgctgctgggcaacggccgctacgtgcccttccacatccaagtgccccaaaagttctttgccatcaagaacctgctcctgctccccggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcaccaggctcaagaccaaggaaactccctccctcggctcgggtttcgacccctactttgtctactcgggctccatcccctacctcgacgggaccttctacctcaaccacaccttcaagaaggtttccatcatgttcgactcctcggtcagctggcccggcaacgaccggctgctcacgccgaacgagttcgagatcaagcgcagcgtcgacggggaaggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggtttcaccggctacctcgcacccaccatgcgtcaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccatgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacataagcatgagcggctccagcgaaagagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgcattcggctggaacccgcgctcgcgcacctgctacatgttcgaccccttcgggttctcggaccgccggctcaagcagatttacagcttcgagtacgaggccatgctgcgccgcagcgccctggcctcctcgcccgatcgctgtctcagtctcgagcagtccacccagaccgtgcaggggcccgactccgccgcctgcggacttttttgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactccccttactttcgctcccaccgcgccgccatcgaacatgccaccgcttttgataaaatgaaacaactgcgtgtatctcaataaacagcactttattttacatgcactggagtatatgcaagttatttaaaagtcgaaggggttctcgcgctcgtcgttgtgcgccgcgctggggagggccacgttgcggtactggtacttgggatgccacttgaactcggggatcaccagtttgggcactggggtctcggggaaggtctcgctccacatgcgccggctcatctgcagggcgcccagtatgtcaggcgcggaaatcttgaaatcgcagttgggaccggtgctctgcgcgcgcgagttgcggtacacggggttgcagcactggaacaccatcagactggggtgcttcacgctggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggccaagatctgcttgaaagcttgctgggccttggccccctcgctgaagaacaggccgcagctcttcccgctgaactggttatttccacacccggcatcatgcacgcagcagcgcgcgtcatggctggtcagttgcaccacgcttcggccccagcggttctgggtcaccttggccttgctgggctgctccttcaacgcgcgctggccgttctcgctggtcacatccatctccaccacgtggtccttgtggatcatcaccgttccatgcagacacttgagctggccctcgacatcggcgcagccgtgttcccacagggcgcagccggtgcactcccaattcttgtgcgcgatcccgctgtggctgaagatgtaaccttgcaacatgcggcccatcacggtgctaaatgatttactggtgctgaaggtcagttgcaggccgcgtgcctcctcgttcatccatgtctgacacatcttttggaagatctcggtctgctcgggcatgagcttgtaagcatcgcgcaggccgctgtcgacgcggtagcgttccatcagcacgttcatggtatccatgcccttctcccatgacgagaccagaggcaaactcagggggttgcgcacgttcaggataccgggggtcgcgggctctacgatgcgttttccgtcctttccttccttcaacaggaccggcggctggctgaatcccactcccacgatcacggcgtcttcctggggcatctcttcgtcggggtctatctttgtcacatgcttggtctttctggcttgcttcttttttggagggctgtccacggggaccacgtcctcttcggaagacccggagcccacccgctgatactttcggcgcttggtgggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggagaacttaaccacccacgaacaagcaaaaatcgagcaggacctgggcttcgaagagccggctcgtctagaacccccacaggatgaacaggagcacgagcaagacgcaggccaggaggagaccgacgctgggctcgagcatggctacctagaggaggacatgctgctgaaacacttgcagcgccaatccctcatcctcagggacgccctggccgaccggagcgagatccccctcagcgtcgaggagctaagtagggcctacgagctcaaccttttctcgccgcgcgtgccccccaaacgccagcccaacggcacctgcgagcccaacccgcgcctcaacttttaccccgttttcgcggtccccgaggccctggccacctatcacatctttttcaagaaccaaaagatccccgtctcctgtcgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgcccttgtagagttggaaggcgacaacgccaggctggccgtactcaagcgcagcgtcgagctcacccacttcgcctaccccgccgtcaacctcccgcccaaggtcatgcgtcgcatcatggatcagctcatcatgccccacatcgaggccctcgatgagacgcaagagcagcggcccgaggacgcccagcccgtggtcagcgacgagcagctcgcgcgctggctcgggaaccgcgacccccaggtcctggagcagcggcgcaagctcatgctggccgtggtccttgtcaccctcgagctggaatgcatgcgccgcttcttcagcgaccccgacaccctgcgcaaggtcgaggagaccctgcactacactttcagacacgggttcgtcaggcaggcctgcaagatctccaacgtggagctgaccaacctggtctcctgcctggggatcctgcacgagaaccgcctgggacagaccgtgctccactctaccctgaagggcgaggcgcggagtgactacgtccgagactgcatctttctctttctctgccacacatggcagtcggccatgggagtgtggcagcagtgtctagaggatgagaacctgaaggagctggacaagcttcttgctagaaacctcaaaaagctgtggacgggcttcgacgagcgcaccgtcgcctcggacctggccgaaatagtcttccccgagcgcctgaggcagacgctgaaaggcgggctgcccgacttcatgagccagagcatgttgcaaaactaccgcactttcattctcgagcgatcggggatcctgcccgccacctgcaacgccttcccctccgactttgtcccgctgagctaccgcgagtgtcccccgccgctgtggagccactgctacctcttgcagctggccaactacatcgcccaccactcggatgtgatcgaggacgtgagcggcgaggggctgctagagtgccactgccgctgcaacctgtgctccccgcaccgctctctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgctgactaccacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggcctgaggatcgcggcgaacgagccctcgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgtttcacaagtactgcgcgctcactcttaaagactaaggcgcgcccacccggaaaaaaggcgggaattacttcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgattggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggcctcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctaaactcttgcaatactctggaccttgtcgtcgtcaactcaacgagaccgtctatctcaccaaccagactgaggtaaaactcacctgcagaccacacaaaacctatatcatctggttcttcgagaacacctcatttgcagttgccaacactcactgcaacgacggtgttgaacttcccaacaacctttccagtggactgagttacgataccagaagagctaaactcgtcctctacaatccttttgtagagggaacctatcattgccagagcggaccttgtactcacaccttccatttggtgaacgtcaccagcagcagcaacagctcagaaactaacctctcttctcgtactaacagacctcattttggaggtgagctaaggcttcccccttctgaggagggggttagcccatacgaagtggtcgggtatttgattttaggggtggtcctgggtgggtgcatagcggtgctagctcagctgccttgctgggtggaaatcaaaatctttatctgctgggtcagacattgtggggaggaaccatgaatgggctcttgctgattatcctttccctggtggggggtgtactgtcatgccacgaacagccacgatgtaacatcaccacaggcaatcatatgagcagagagtgcactgtagtcatcaaatgcgagcacgactgcccactaaacattacattcaagaataacaccatgggaaatgtatgggtgggtttctgggaaccaggagatgagcagaactacacggtcactgtccatggtagcaatggaaatcacactttcggtttcaaattcatttttgaagtcatgtgtgatatcacactgcatgtggctagacttcatggcttgtggccccctaccaaggagaacatggttgggttttctttggcttttgtgatcatggcctgcttgatgtcaggtctactggtaggggctttagtgtggttcctgaagcgcaagcctaggtacggaaatgaagaaaaggaaaaattgctataatctttttctttttcacagaaccatgaatgctttgaccagtgtcgtgctgctctctcttcttgtagcttttagtaatggggaagctgaaactgtagttgtaaatgttaaatctggtacaaaccacacccttgaaggtcctagaaaaactccagttcagtggtatgggggtgctaactttgacatgttttgcaatggctctaaaatacatcacaaggaattgaatcacacttgctctattcagaacataactcttacattcataaacagaacacatcatggaacatactatggttttggctatgacaatcaaaattcaaaagtgtatcatgtcagagtagatgtagagcctcctagaccccgtgctacttgggctcctcctcaggacataactattaagtatggttcaaatagaacattgcagggcccaagtgttactccagttagttggtatgatggtgaaggaaatcggttttgcgatggagataaaattgatcatacagaaattaatcacacttgcaatgctcaaaaccttactttgctatttgtgaatgaaacacatgaaagaacatattatggaattagtggtgattggaaacagcgaaatgagtatgatgttactgttacaaagacacatttaaatattaaaaatttgggccaacgcaaaactgatgaaaaccataaaaatggaatgcaacagaaagtcgaacaaaagccttcaaaaaggcctaaacaaaaaacattgcaaactacaattcaggttatgattcctattggaactaattatactttagtggggccttcgccaccagtgagctggcatactacaaaaaatggcttaacagaactctgtaatggaaaccctattttaagacacacttgtgatgggcaaaatattacacttattaatgttaatgctacatttgaagctgattactatggctcgaacaataagagtgaatcaaaacactacagagtcaaggttttcaaagaaagaaaagatcaggcactattattcagaccgcttactaccaaaggaagcatgatcattactactgaaaatcaaaactttgaattgcaaaaaggtgacaatcaagatgatgacaaaattccatcaactactgtggcaatcgtggtgggtgtgattgcgggctttgtgactctgatcattgtcttcatatgctacatctgctgccgcaagcgtcccaggacatacaatcatatggtagacccactactcagtttctcttactgaaactcagtcactctcatttcagaaccatgaaggctttcacagcttgcgttctgattagcatagtcacacttagtgcagccgcagctaaatgcttccatacttataacttaactagaggggaaaatattacattatcaggtgctggtttaaacacaacatgggaagcgtatcacaatgggtggaaacaagtttgtccatggaatgacggacgctatgtgtgcgttggaaacagcagtaccataactaaccttacagttgtggctaatgcaaatttatcatcaactgttaaatttagagctgaaagtttatacattggaactgatggatatgaaagcaatccatcatgcttttatactgtcaatgtaattgagcttccaaccaccagatcgccaactaccaccacagtcagtacaactgctgaaaccacaactcacactacacagttagacactacagagcagaatagtactgtattggttaggtatttgttaagggaggagagtactactgaacagacagaggctacctcaagtgccttcagcagcactgcaaatttaacttcgcttgcttggactaatgaaaccggagtatcgttgatgaatcgccagccttactcaggtttggatattcaaattacttttctggttgtctgtggaatctttattcttgcggttcttctgtactttgtctgctgcaaagccagagaaaaatctaggcggcccatctacaggccagtaatcggggaacctcagccactccaagtggatggaggcttaaggaatcttctcttctcttttacagtatggtgatcagccatgattcctaggttcttcctatttaacatcctgttctgtctcttcaacatctgcgctgccttcgcggccgtctcgcacgcctcgcccgactgtctcgggcccttccccacctacctactctttgccctactcacctgcacctgcgtctgcagcattgtctgcgtggtcataaccttcctgcagctcatcgactggtgctgcgcgcgctacaattacctacaccacagtcccgaatacagggacgagaacgtagccagaatcttaaggctcatctgaccatgcagactctgctcatgctgctatccctcctatcccctgccctcgccacttctgctgattactctaaatgcaaattcgcggacatatggaatttcttagattgctatcaggagaaaattgatatgccatcctattacttggtgattgtgggaatagtcatggtctgctcctgcactttctttgccatcatgatctacccctgttttgatctcggctggaactctgttgaggcattcacatacacactagaaagcagttcactagcctccacgccaccacccacaccgcctccccgcagaaatcagtttcccctgattcagtacttagaagagccccctccccggcccccttccactgttagctactttcacataaccggcggcgatgactgaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccaacggctgcatccactgctcctgcgaaagccccgagtgcatctactccctcctcaagaccctttgcggactacgcgaccttctccccatgaactgatgttgattaaaagcccaaaaaccaatcatacccttcccccatttccccacccccaatcataagaataaatcattggaactaaacattcaataaagatcacttacttgaaatctgaaagtatgtctctggtgtagttgttcagcaacacctcagtaccctcctcccagctctggtactccagtccccggcgggcggcgaacttcctccacaccttgaaagggatgtcaaattcctggtccacaattttcattgtcttccccctcagatgacaaagaggctccgggtggaagatgacttcaaccccgtctacccctatggctacgcgcggaatcagaatatccccttcctcactcctccctttgtctcctccgatggattccaaaacttcccccctggtgtcctgtcactcaaattggctgacccaatcgctatcagcaatggtgatgtctcactcaaggtgggagggggactcactgtggaacaagatagtggaaacctaagtgtgaatcctaaggctccattgcaagttggaacagacaaaaaactggaattggctttagcacctccatttaatgttaaagataataagctagctctgctagtaggagatggattaaaagtaatagatagatcaatatctgacttgccaggattgttaaattatcttgtagttttgactggcaaaggaattggaaatgaagaattaaaaaatgacgatggtagcaataaaggagtcggtttatgtgtaagaactggagaaggaggtggtttaacttttgatgataaaggttatttagtagcatggaacaagaaacatgacatccgcacactttggacaactttagacccttctccaaattgtagaatcgatgtggacaaggactctaaactaacattggtccttacaaagtgcggaagtcagatattggctaatgtatctcttcttgttgtcaaaggaaggtttcaaaacctaaattacaaaacaaacccaaaccttcctaaagcatttgcaataaaattactgtttgatgaaaatgggattcttaaagactcatcaaatcttgacaagaactattggaactatagaagcggaaattctattttagcagagcaatataaaaatgcagttggctttatgccaaatttagcagcttatcccaaatctaccaccactcagtctaaactttatgcaagaaacactatttttggaaatatttacctggattcgcaagcatataatccagtggttattaaaattacttttaatcaagaagcagatagtgcttattctatcactttaaactattcatggggtaaggattatgaaaatatcccttttgattctacttcttttaccttttcctatatcgcccaagaatgaaagaccaataaacgtgtttttcatttgaaaattttcatgtatctttattgatttttacaccagcacgggtagtcagtctcccaccaccagcccatttcacagtgtaaacaactctctcagcacgggtggccttaaacagggaaatgttctgattagtgcgggaactggacttggggtctataatccacacagtttcctggcgagccaagcgggggtcggtgattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcagcagtctctgccgccggggctcggtgcggctgctgcagatgggatcgggatcgcaagtctctctgactatgatccccacagccttcagcatcagtctcctggtgcgtcgggcacagcaccgcatcctgatctctgccatgttctcacagtaagtgcagcacataatcaccatgttattcagcagcccataatttagggcgctccagccaaagctcatgttggggatgatggaacccacgtgaccatcgtaccagatgcggcagtatatcagatgcctgcccctcatgaacacactgcccatatacatgatctctttgggcatgtttctgttcacaatctgccggtaccatgggaatcgctggttgaacatgcacccgtaaatgactctcctgaaccacacggcc

SEQ ID NO: 1438 - DNA, 32767 bp, Human adenovirus 66
catcatcaataatataccttatagatggaatggtgccaatatgcaaatgaggtaatttaaaaaagtgcgcgctgtgtggtgattggctgtggggtgaacggctaaaatgggcggggcggccgtgggaaaatgacgtgacttatgtgggaggagctatgttgcaagttattgcggtaaatgtgacgtaaaacgaggtgtggtttgaacacggaagtagacagttttcccacgcttactgacaggatatgagagtagttttgggcggatgcaagtaaaaattctccattttcgcgcgaaaactgaatgagaatatgaatttctgagtcatttcgcggttatgacagggtggagtatttgccgagggccgagttagactttgaccgtttacgtggaggtttcgattaccgtggtttttacctaaatttccgcgtacggtgtcaaagtcctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgtttcctgccacaggagattatctccagtgaaaccgggattgaaatactggagtttgtggtaaataccctaatgggagacgacccggaaccgccagtgcagccttttgatccacctacgctgcacgatctgtatgatttagaggtagacgggccggaggatcccaatgaggaagctgtgaatgggttttttactgattctatgctgctagctgccgatgaaggattggacataaaccctcctcctgagacccttgataccccaggggtggttgtggaaagcggcagaggtgggaaaaaattgcctgatctgggagcagctgaaatggacttgcgttgttatgaagagggttttcctccgagtgatgatgaagatggggaaattgagcagtccatccataccgcagtgaataagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataatttgaatggtagatttatatttttacttgcgatttttttgtaggtcctgtgtctgatgatgagtcaccttctcctgattcaactacttcacttcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttgttgggtggggacttggatatataagtaggagcagatctgtgtggttagctcacagcaacctgctgccatccatggaggtttgggctatcttggaagacctcagacagactaggctactgctagaaaacgcctcggacggagtctctggcctttggagattctggttcggtggtgatctagctaggctagtgtttaggataaaacaggactacagggaagaatttgaaaagttattggacgacagtccaggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggcattaagagggagaggaatcctagtgggaacaattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcagtaacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtgaagagtcagttgtctgtaaagaaatgcatgtttgagagatgtaatcttggcatactgaatgaaggtgaagcaagggtccgccactgcgcggctacacaaactggctgcttcattctaataaagggaaatgccagtgtaaagcataatatgatctgtggacattcggatgagaggccttatcagatgctgacctgcgctggtggacattgcaatattcttgctaccgtgcatatcgtttcacatgcacgcaagaaatggcctgtatttgaacataatgtgattaccaagtgcaccatgcacataggtggtcgcagaggaatgtttatgccttaccagtgtaacatgaatcatgtgaaggtgatgttggaaccagatgccttttccagagtgagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagtttggttctagtggtgaagaaactgactaaagtgagtagtggggcaagatgtggatggggactttcaggttggtaaggtggacaaattgggtaaattttgttaatttctgtcttgcagctgccatgagtggaagtgcttcttttgaggggggagtatttagcccttatctgacgggcagactcccaccatgggcaggagttcgtcagaatgtcatgggatctactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaagccttaacccaacgcttaggcgaactgtctaagcaggtggcccagttgcgtgagcaaactgagtctgctgttgccacagcaaagtctaaataaagatctcaaatcaataaataaagaaatactgattatgaaacaaatgaatgtttatttgatttttcgcgcgcggtatgccctggaccatcggtctcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttaagctgggacgggtgcattcggggtgaaattatatgcattttggactggatcttaaggttggcaatgttgccgcctagatcccgtctcgggttcatattgtgcaggaccaccaagacagtgtatcctgtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttgcgggggtctgaaacatcatagttatgctcctgagtcaggtcatcataagccattttaataaactttgggcggagggtgccagattggggaatgaaagttccctctggcccgggagcatagtttccctcacatatttgcatttcccaggctttcagttcagagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttgccttacatggatattttcccgcaccaagtccgttaggaggcgctctcccccaagggatagaagctcctggagcgaggagaagtttttcagcggctttagcccgtcagccatgggcattttggaaagagtctgttgcaaaagctcgagccggtcccagagctcggcgatgtgctctatggcatctcgatccagcagacctcctcgtttcgcgggttgggacggctcctggagtagggaatcagacgatgggcgtccagcgctgccagggtccgatccttccatggtcgcagcgtccgagttagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccataagttcgtagttaagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactctacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggtctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatttggtcagaaaacacaatcttcttgttgtccagcttggtagcaaatgatccatagagggcattggatagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgagctcatcaggggggtccgcatctatggtaaatattcccggtaacaaatctttgtcaaaatagctaatggtggtgggatcatccaaggtcatctgccattctcgaactgccagcgcgcgctcataggggttaagaggggtgccccagggcatggggtgggtgagcgcggaggcatacatgccacagatatcgtatacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaatttgaagagatagtaggtctctggaatatgttaaaatgggcatgaggtaggcctacagagtcccttatgaagtgggcatatgactcttgcagcttggctaccagctcggcggtgacgagtacatccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtccatgtcatcacaggccccctgttcccagagttggaagtccacccgcttcttgtaggcggggttgggcaaagcgaaagtaacatcattgaagaggatcttgccggccctgggcatgaaatttcgggtgattctgaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttgaggaaggaggaccagaggtccactgcgagtgctgtttgtaactggtcccggtattgacgaaaatgctgcccgactgccattttttctggggtgacgcaatagaaggtttgggggtcctgccgccagcgatcccacttaagtttcatggcgaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacaaacggccgcagtactcgcagcgattcacgggatgcacctcatgaatgagttgtacctgacttcctttgacgagaaatttcagtggaaaattgaggcctggcgtttgtacctggcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttggagggcgtgagggaggttcagatggtacttgatctccacgggtccgttggtggagatgtcaatggcttgcagggttccgtgccccttgggcgctaccaccgtgcccttgtttttccttttgggcggcggtggctctgttgcttcttgcatgtttaggagcggtgtcgagggcgcgcaccgggcggcaggggcggctcgggacccggcggcatggctggcagtggtacgtcggcgccgcgcgcgggtaggttctggtactgcgccctgagaagactcgcatgtgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttatcctggtaggcgatctcgaccatgaactgctggatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcataaccacctgggcgaggttaagctctacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggatgagttcggcaatggtggtgcgcacctcgcgctcgaaatcccccgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacacctccgcgcatctccctgaagtggtgactgggaggctctccgttgggcagggacaccgcgctgattatgcattttatcaattgccccgtaggtactccgcgcaaggacctgatcgtttcaagatccacgggatctgaaaacctttcgacgaaagcgtctaaccagtcgcaatcgcaaggtaggctgagcactgtttcttgcgggcgggggcggctagacgctcggtcggggttctctctttcttttccttcctcctcttgggaggatgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtctacaaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccgatgagaaagtgtggcggtggctggcggtacaggggccatcgctctgtagccggggctccgggggcaaggtcttccagcatgaggcggtggtaaccgtagatgtacctggacatccaggtgataccggaggcggtggtggatgcccgcgggaactcgcgtacgcggttccagatgttgcgcagcggcatgaagtagttcatggtaggcacggtttggcccgtgagacgtgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttgctttttcctggatgggagccagtgctgcgtcaagctttagaacactcagttctcggggctgggagtggctcgcgcccgtagtctggagaattaatcgccagggttgcgttgcggtgtgccccggttcgagtcttagcgcgccggatcggccggtttccgcgacgtttctaagaccccgccagccgacttctccagtttacgggagcgagcccttcttttttttttttgttttttttgtttgcccagatgcatcccgtgctgcgacagatgcgcccccagcaacagcccccttctcagcagcagctacaacgacagccacaaaaggctcttcctgctcctgtaactactgcggctgcagccgtcagcggcgcgggacagcccgcctatgatctggaattggaagagggcgagggactggcgcgcctgggcgcaccatcgcccgagcggcacccgcgggtgcaactgaaaaaggactctagcgaggcgtacgtgccccagcagaacctgttcagggacaggagcggtgaggagccagaggagatgcgagcatctcgatttaacgcgggtcgcgagctgcgccacggtctggatcgaagacgggtgctgcaagacgaggattttgaggtcgatgaagtgacagggatcagcccagctagggcacatgtggccgcggccaacctagtctcagcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcacccagaaccccactagcaaacccctgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtaaagatagatgggttttacatgcgcatgactctcaaggtgctgactttgagcgacgatctgggggtgtatcgcaatgacaggatgcaccgtgcggtgagcgccagcaggaggcgcgagctgagcgacagagaacttatgcacagcttgcaaagagctctaacgggggctgggaccgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttcggctatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcagaccaacctggaccggatggtgaccgatgtgcgcgaggccgtgtctcagcgcgagcggttccagcgcgacgccaacttgggatcgttggtagcgctaaacgctttcctcagcacccagcccgctaacgtgccccgtggtcagcaagactatacaaactttttgagtgcattgagactcatggtagctgaggtgcctcagagcgaggtgtaccagtccgggccagattacttcttccagaccagcagacagggcttgcagacagtgaacctgactcaggctttcaagaacctgaagggtctctggggagtgcacgccccagtaggggatcgcgcgaccgtgtctagcttgctgactcccaactcccgcctgctgctgctgctggtatccccctttactgacagcggtagcatcgaccgcaactcgtacttgggctacctgcttaacctgtatcgcgaggccatagggcagagccaggtggacgagcagacctatcaagaaatcacccaagtgagccgcgccctgggtcaggaagacacgggcagtttggaagccaccctgaacttcttgctaaccaaccggtcgcagaagatccctcctcagtatgcgcttaccgctgaggaggagcggatcctcagatacgtgcaacagagcgttggactgtttctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattctccccgcctcccggttatacagtttggaagaaggaagggggcgatagaagacactcttccgtgtcgctgtccagaacggctggtgctgccgccaccgtgcccgaagctgcaagtcctttccctagcttgcccttttcactaaacagcgttcgcagcagtgaactggggagaataacccgcccgcgcttgatgggcgaggatgagtacttgaatgactctttgttgaggccagagagggaaaagaacttccccaacaatggaatagagagcctggtggataagatgagtagatggaagacctatgcgcaggatcacagagacgagcccaaaatcttgggggctacaagcagaccgacccgtagacgccagcgccacgacagacagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaatgcaactcaccaaggccatggcgaccgagcgtgcgttcgttcttttttgtatctgtgtttagtacgatgaggagacgagccgtgctaggcggagcggtggtgtatccggagggtcctcctccttcttacgagagcgtgatgcagcaacaggcggcgatgctacagcccccactggaggctcccttcgtacccccgcggtacctggcgcctacggaagggagaaacagcattcgttactcggagctgtcgcctctgtacgataccaccaagttgtatctggtggacaacaagtcggcggacattgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttatagtaaatgacacctatgatcataaagaggatatcttaaagtatgagtggtttgagttcactttaccagaaggcaacttctcagccaccatgaccattgacctgatgaacaatgccatcattgacaactacctggaaattggcagacaaaatggagtgctggaaagtgacattggtgttaagtttgacactagaaactttaggctcgggtgggaccccgaaactaagttgattatgccaggagtctacacttatgaggcattccatcctgacattgtattgctgcctggttgcggggtagactttactgaaagccgacttagcaacttgcttggcatcaggaaaagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgataatataactagaggagatacttatataactgaaaaacaaaaacgtgaagctgcagctgctgaagttaaaaaagagttaaagatccaacctctagaaaaagacagcaagagtagaagctacaatgtcttggaagacaaaatcaacacggcctaccgcagctggtacctgtcctacaattacggtaaccccgagaaaggaataaggtcttggacactgcttaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaatgtccattctcatctcgcccagtaataataccggttggggactgtatgcgcccaccaagatgtatggaggcgcccgcatacgctctacccagcaccctgtgcgcgttcgcggtcatttccgcgctccatggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcattgccaggcgccacagggctactaccgccatgcgagctgcaaaagctattctgcggagggccaaacgtgtggggcgaagagccatgcttagagcggccagacgcgcggctttaggtgccagcagcggcaggtcccgcaggcgcgcggccacggcggcagcagcggccattgccaacatggcccaaccgcgaagaggcaatgtgtactgggtgcgtgatgccactaccggccagcgcgtgcctgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccaccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccggaaccactgtggtttttacacctggcgagcgttccagcactacttttaaacggtcctatgatgaggtgtacggggatgacgatattcttgagcaggcggcagaccgccttgatgagtttgcttatggcaagcgcactagatccagtcccaaagaggaggctgtgtccattcccttggatcatggaaatcccacccccagcctcaaaccagtcaccttgcagcaagtgctgcccgtgcctgcgcggagaggcgtaaagcgcgagggtgaggacctatatcctaccatgcagctaatggtgcccaagcgccagaggctagaagacgtactggagaaaatgaaagtggatcccgatatccagcctgaggtcaaagtaagacctatcaaggaagtggcgccaggtttgggagtacaaaccttcgacatcaagattcccaccgagtccatggaagtgcagaccgaacctgcaaaacccacaaccacctcaattgaggtgcaaacggaaccctggacgcccgcgcccgttgtcgcccccagcaccactcgaagatcacgacgaaagtacggcccagcaagtcttctaatgcccaactatgctctgcacccatccatcattcccactccgggttacagaggcactcgctactatcgaaaccggagcaacacctctcgccgccgcaaaccacctgcaagtcgcactcgcagtcgccgccgccgcaacactgccagcaaagtgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttccgtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatttggccaaccaggctgtacaaaaacagataaacagccgcctggacccgccgcccgcaacccctggtgaaatggaagtggaggaagaacttcctccgctggaaaagcggggcgacaagcgtccgcgacccgagctggagcagacactggtgacgcgcgcagacgagcccccttcatacgaggaggcagtaaagctcggaatgcccactaccaggcctgtagctcacatggctaccggggtaatgaaaccttctcagacacatcgacccgccaccttggacttgcctcctccccctgcttctgcggcacctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgactgatgctgcgcttcgtgcccgttgaccgggaggacaatacatactcttacaaagtgcggtacaccctcgccgtgggcgacaacagagtgcttgacatggccagcacattctttgacattaggggggtgcttgatagaggtcctagcttcaagccatattccggcacagcttacaattcactggctcctaagggcgcgcctaacacatctcagtggatagttacaacgggagaagacaatgccaccacatacacatttggcattgcttccacgaagggagacaatattactaaggaaggtttagaaattgggaaagacattactgcagacaacaagcccatttatgccgataaaacatatcagccagagcctcaagttggagaagaatcatggactgatattgatggaacaaatgaaaaatttggaggtagagctcttaaaccagctactaaaatgaagccatgctacgggtcttttgcaagacctacaaacataaaagggggccaagctaaaaacagaaaagtaacaccaaccgaaggagatgttgaagctgaggagccagatattgatatggaatttttcgatggtagagaagctgctgacgctttttcgcctgaaattgtgctttacacggaaaatgtcaatttggaaactccagacagccatgtggtatacaagccaggaacttctgatggtaactctcatgcaaatttgggtcaacaagccatgcctaacagacccaattacattggcttcagggataactttgtaggtcttatgtactacaacagtactggaaatatgggagttttggccggccaagcatcacaactgaatgcagtggttgacttgcaggacagaaacactgaactgtcatatcagcttttgcttgattctctgggagacagaagcagatacttcagcatgtggaatcaggctgtggacagctatgatcccgatgttcgtattattgaaaatcatggcgtcgaggatgaactgcctaattactgttttcctctggatggcataggaccagggaacaaatatcaaggcattaaacctagagacactgcatgggaaaaagatactaaagtttctacagctaatgaaatagccataggcaacaatctggctatggaaattaatatccaagctaatctttggagaagttttctgtactccaatgtggctttgtaccttccagatgtttacaagtacacgccaactaacattactctgcccgctaacaccaacacctatgagtacatgaacgggcgagtggtttccccatctctggtcgattcatacatcaacattggcgccaggtggtctcttgacccaatggacaatgtgaatccatttaaccaccaccgcaatgctggcctacgctaccggtccatgcttctgggcaatggccgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaccataagtttcaccagcatcaacctctatgccaccttcttccccatggctcacaacaccgcttcaactcttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcaccagactcaaaaccaaggagactccatctcttggatcagggttcgatccctacttcgtttattctggatctattccctacctggatggcactttttaccttaaccacactttcaagaaggtctccatcatgtttgactcctcagtcagctggcctggcaatgacaggctgttgtctccaaatgagtttgaaatcaagcgcactgtggatggggaaggatacaatgtggcccaatgcaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccatatcaacacaacaactctggctttgtaggataccttgcgcctactatgagacaaggggaaccttacccagccaattatccatacccgctcatcggaactactgccgttaaaagtgttacccaaaaaaagttcctgtgcgacaggaccatgtggcgcataccgttctccagcaacttcatgtccatgggagcccttacggacctgggacagaacctgctctatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggttgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgccccatgaacggaaaccccaccatgaagttgctgactggggtgcccaacagcatgctccaatctccccaagtgcagcccaccctgcgccgcaaccaggaggcgctatatcgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctcgttttttactcattcgttttcattattcactcagaaatcaaatgggttctggcgggagtcaaagtgacccgcgggcagggatacgttgcggaactgtaacctgttctgccacttgaactcggggatcaccaacttgggaactggaatctcgggaaaggtgtcttgccacaactttctggtcagctgcagggcgccaagtaggtcaggagcagagatcttgaaatcacagttgggaccggcattctggacacgggagttgcggtacactgggttgcaacactggaacaccatcaaggctgggtgtctcacgcttgccagcacggtcgggtcactgatggtagtcacatccaagtcttcagcattggccatcccaaagggggtcatcttacaggtctgcctgcccatcacgggagcgcagcctggcttgtggttgcaatcgcaatgaatggggatcagcatcatcctggcttggtcgggggttatccctgggtacacggccttcatgaaggcttcgtactgcttgaaagcttcctgagccttacttccctcggtatagaacatcccacaggacttgctggaaaattgattagtagcacagttggcatcatttacacagcagcgggcatcgttgttggccaactggaccacatttctgccccagcggttctgggtgatcttggctctgtctgggttctccttcatagcgcgctgtccgttctcgctcgccacatccatctcgataatgtggtccttctgaatcatgatagtgccatgcaggcatttcaccttgccttcataatcggtgcatccatgagcccacagagcgcacccggtgcactcccaactattgtgggcgatctcagaataagaatgtaccaatccctgcatgaatcttcccatcatcgctgtcagggtcttcatgctactaaatgtcagcgggatgccacggtgctcctcgttcacatactggtggcagatacgcttgtactgctcgtgctgctctggcatcagcttgaaagaggttctcaggtcattatccagcctgtacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcgtggccgatgtcttgcagagggacatgcttggtctttctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtctggccttggaagcggatggctgacagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtccagctaccaccacctctaccctcgatgatgaggaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcatcggggatcaagttgccgactacctcaccgggcttgggggggaagacgtgctcctcaaacatctagcaaggcagtcgaacatagttaaagacgcactactcgacctcaccgaagtgcccatcagtgtggaagagcttagccgcgcctacgagctgaacctcttttcgcctcacataccccccaagcggcagccaaacggcacctgcgaggccaaccctcgactgaacttctatccagcttttactgtccccgaagtgctggccacctaccacatcttttttaagaaccaaaagattccagtctcctgccgcgccaaccgcacccgcgccgatgcccttctcaacttgggtccgggagctcgcttacctgatatagcttccttggaagaggttccaaaaatctttgagggtctgggaagtgatgagactcgggccgcaaatgctctgcaacagggagagaatggcatggatgaacatcacagcgctttagtggaactggagggtgacaatgcccggcttgcagtgctcaagcgcagtatcgtggtcacccattttgcctaccccgctgttaacctgccccccaaagttatgagcgctgttatggaccatctgctcatcaaacgagcaagacccctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccggctagggcagagcgtcctgcacaccacccttaaaggggaggcccgccgtgactacatccgagactgtgtctacctttacctctgccatacctggcagactggcatgggtgtgtggcaacagtgtttggaagagcagaacctaaaagagctggacaagctcttgcaaagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggtctgctggaatgccactgccgctgcaatctttgcacaccccaccgctcccttgcctgcaacccccagttgctgagcgagacccagatcatcggcaccttcgagttgcagggtcccagcagtgaaggcgaggggtcttctccggggcagagtctgaaactgacaccggggctgtggacctccgcctacctgcgcaagtttcatcccgaggattaccacccctatgagatcaggttctatgaggaccagtcacatcctcccaaagtcgagctctcagcctgcgtcatcacccagggagcaattctggcccaattgcaagccatccaaaaatcccgccaagaatttctactgaaaaagggaagcggggtctaccttgacccccagaccggtgaggagctcaacacaaggttcccccaggatgtcccatcgccgaggaagcaagaagctgaaggtgcagctgacgcccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggtccagcggcggcccaacagtagatgggacgagaccgggcgattcccaaacccgaccaccgcttccaagaccggtaagaaggagcgacagggatacaagtcctggcgtggacacaaaaacgctatcatctcctgcttgcatgaatgcgggggcaacatatccttcacccggcgatacctgctcttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatctacaacaagtgcagcaggaggaggactgaggatcacagcgaacgagccagcgcagaccagagagctgaggaaccggatctttccaaccctctatgccatcttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgcttattcgaaaacggcgggaatcacgtcaccattggcacctgtcctttgccctagtcatgagtaaagagattcccacgccttacatgtggagctatcagccccaaatggggttggcagcaggcgcctcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaactcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccagatcgccggctgtgggagatcttccttcacccctcgtcaggctgtactgactttggagagttcgtcctcgcagccacgctcgggcggcatcggaactctccagttcgtggaggagtttactccctctgtctacttcaaccccttctccggctctcctggccagtacccagacgagttcataccgaacttcgacgcaatcagcgagtcagtggatggctatgattgatgtctaatggtggcgcggctgagctagctcgactgcgacacctagaccactgccgccgctttcgctgcttcgcccgggaactcaccgagttcatctacttcgaactccccgaggagcaccctcagggtccggcccacggagtgcggattaccatcgaagggggaatagactctcgcctgcatcgaatcttctcccagcgacccgtgctgattgagcgcgaccagggaaatacaaccatctccatttactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacgttaggagtagttgcgggtgggcttgtgctaatcctttgctacctatacataccttgctgtgcatatttagtcatattgcgctgttggtttaaaaaatgggggccatattagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgtttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgttcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattattagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtataaaattttcatgcaacggaagagacttgaccattattaacataacatcaaatgagcaaggcttctattatggaaccaactataaaaatagtttagattacaacattattgtagtgccagccaccacgtctgctccccgcaaatccactttctctagcagcagtgccaaagcaagcacaattcctaaaacagcttctgctattttaaagcttccaaaaatcgctttaagtaattccacagccgctcccaatacaattcctaaatcaacaattggcatcattactgccgtggtagtgggattaatgattatatttttgtgcataatgtactacgcctgctgctatagaaaacatgaacaaaaaggtgatgcattactaaattttgatgtttaattttttattagtattatgatattgtttcaatcaaataccactaacactatcaatgtgcagactactttaaatcatgacatggaaaaccacactacctcctatgcatacaatgttcatagaaattctaaaagacgtcccatctattcttctatgattagtcgtccccatatggctctgaatgaaatctaagatctttttttttctcttacagtatggtgaacatcaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccaaatgaacatatcccactacaacacgtacaacaaccactagcactggtagagtatgaaaatgagccacaaccttcactgccccctgccattagttacttcaacctaaccggcggagatgactgacccaatcgccacatcatccaccgctgccaaggagctgctggacatggacggacgtgcctcagaacagcgactcatccaactacgcattcgtcagcagcaggaacgagcagtaaaagagctaagggatgccattgggattcaccagtgcaaaaaaggcatattctgcttagtaaaacaatccaaaatctcctacgagatcaccgctactgaccatcgtctctcatacgagctcggtccgcagcgacaaaaattcacctgcatggtgggaatcaaccccatagttatcacccagcagtctggagatactaagggttgcatccactgttcctgtgattccaccgagtgcatctacacactgctgaagaccctctgcggccttcgagacctcctacccatgaactaatcattgccccctcccttacccaatccaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcaacttacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaagctcggaaatggtcttacatttgactcttccaattctattgcactcaaaaataacactttatggacaggtccaaaaccagaagccaactgcataattgaatacgggaaagaaaacccagatagcaaactaactttaatccttgtaaaaaatggaggaattgttaatggatatgtaacgctaatgggagcctcagactatgttaacaccttatttaaaaacaaaaatgtctccattaatgtagaattatactttgatgccactggtcatatattaccagacttatcttctcttaaaacagatctacaactaaaatacaagcaaaccactcactttagtgcaagaggttttatgccaagtactacagcgtatccatttgtccttcctaatgcgggaacagataatgaaaattatatttttggtcaatgctactacaaagcaagcgatggcgccctttttccgttggaagttactgttacgcttaataaacgcctgccagatagtcgcacatcctatgttatgacttttttatggtccttgaatgctggtctagctccagaaactactcaggcaaccctgataacctccccatttaccttttcctatattacagaggatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtgatacataaaaatgcatcgggatagtcttttaaagcgctttcacagtccaactgttgcggatgcgactccggagtctgaatcacggtcatctggaagaagaacgatgggaatcataatccgaaaacggaatcgggcgattgtgtctcatcaaccccacaagcagccgctgtctgcgtcgctccgtgcgactgctgtttataggatcgggatccacagtgtcctgaagcatgattttaatagcccttaacattaactttctggtgcgatgcgcgcagcaacgcattcttatttcacttagattactacagtaggtacagcacattatcacaatattgtttaataaa

SEQ ID NO: 1439 - DNA, 32767 bp, Human adenovirus 65
catcatcaataatataccccacaaagtaaacaaaagttaatatgcaaatgagcttttgaatttggggcgtggtcgtcgctgattggccgagaaacggtgatgcaaatgacgtcacgacgcacggctaacggtcgccgcggaggcgtggcctagcccggaagcaagtcgcggggctgatgacgtataaaaaagcggactttagacccggaaatggccgattttcccgcggccacgcccggatatgaggtaattctgggcagatgcaagtgaaattaggtcattttggcgcgaaaactgaatgaggaagtgaaaagcgaaaaataccgatcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgcctcctgcctgcaactgtgcccttggacatggccgcattattgctggatgactttgtgagtacagtattggaggatgaactgcaaccaactccgttcgagctggggcccacacttcaggacctctatgatctggaggtagatgcccaggaggacgacccgaacgaagaggctgtgaatttaatatttccagaatctctgattcttcaggctgacatagccagcgaagctgtacctacaccacttcatacaccgactctgtcacccatacctgaattggaagaggaggacgaactagacctccggtgttatgaggaaggttttcctcccagcgattcagaggacgaacggggtgagcagagtatggctataatctcagactgtgcttgtgtggttgtggaagagcattttgtgttggacaatcctgaggtgcctgggcaaggctgtagatcctgccaatatcaccgggatcagaccggagaccaaaatgcttcctgtgctctgtgttacatgaaaatgagcttcagctttatttacagtaagtggagtgaatgtgagagaggctgagtgcttaacacatcactgtgtgatgcttgaacagctgtgctaagtgtggtttatttttgttactaggtccggtgtcagaggatgagtcatcaccctcagaagaagaccacccgtctccccctgatctcacagatgacacgcccctgcaagtgatcagacccaccccagtcagactcagtggggagaggcgaatggctgttgacaaaatcgaggacttgttgcaggacatgggtggggatgaacctttggacctgagcttgaaacgccccaggaactaggcgcagctgtgctgagtcatgtgtaaataaagttgtacaataaaagtatatgtgacgcatgcaaggtgtggtttatgactcatgggcggggcatagtcctatataagtggcaacacctgggcactcgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggatacatcctggacttcgcggccatgcacctgtggagggcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtgaagagggagaggagcgatgggggcaataccgggatgatgaccgagctgacggccagcctgatgaatcgcaagcgcccagagcgcattacctggcacgagctacagatggagtgcagggatgaggtgggcctgatgcaggataaatatggcctggagcagataaaaacccactggttgaacccagatgaggattgggaggaggccattaagaaatatgccaagatagccctgcgcccagattgcaagtacagggtgaccaagacggtgcatatcagacatgcctgctacatctcagggaacggggcagaggtggtcatcgataccctggacaaggccgccttcaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgaggcactgctcttccctggagacgggctgcttctgcctggtgaagggcacagcctctttgaagcataatatggtgaagggctgcacggatgagcgcatgtacaacatgctgacctgcgactcgggggtctgtcatatcctgaagaacatccatgtgacctcccacccacgtaagaagtggccagtgtttgagaataacctactgatcaagtgccatgtgcacctgggcgccagaaggggtaccttccagccgtaccagtgcaactttagccagaccaagctgctgttggagaacgatgccttctccagggtgaacctgaacggcatctttgacatggatgtctcggtgtacaagatactgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgctcgacagcaccgccgcagccgcggcagccgcagccgccatgacagcgacgagactggcttcaagctacatgcccagcagcagcagtagcccctctgtgccaagttccatcatcgccgaggagaaactgctggccctgctggccgagttggaagctctgagccgccagctggccgccctgacccagcaggtgtccgatctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtgtagtttggcctggatcttgaggttggcgatgttgccacccagatcccgccgtgggttcatgttgtgcagcaccaccaggacggtgtagcccgtgcacttggggaatttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcaaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggagatgcagctgccgtcgtcccggaggaggggggccacctcgttgagcatgtccctgacttggaggttttcccggacgagctcgccgaggaggcggtccccgcccagcgagagcagctcttgcagggaagcaaagtttttcaggggcttgagcccgtcggccatgggcatcttggcgagggtctgcgagaggagctcgaggcggtcccagagctcggtgacgtgctctacggcatctcgatccagcagacttcctcgtttcgggggttgggacgactgcgactgtagggcacgagacgatgggcgtccagcgctgccagcgtcatgtccttccagggtctcagggtccgcgtgagcgtggtctccgtcacggtgaaggggtgggccccgggctgggcgcttgcaagggtgcgcttgagactcatcctgctggtgctgaaacgggcacggtcttcgccctgcgcgtcggcgagatagcaattgaccatgagctcgtagttgagggcctcggcggcgtggcccttggcgcggagcttgcccttggaagagcgcccgcaggcgggacagaggagggattgcagggcgtaaagcttgggtgcgagaaagacggactcgggggcgaatgcatccgctccgcagtgggcgcagacggtctcgcactccacgagccaggtgagctctggctgctcggggtcaaaaaccagttttcccccgttctttttgatgcgcttcttacctcgcgtctccattagtctgtgtccgcgctcggtgacaaacaggctgtctgtgtccccgtagacggacttgatgggcctgtcctgcaggggcgttccgcggtcctcctcgtagagaaactcggaccactctgagacaaaggcgcgcgtccacgccaagacaaaggaggccacgtgcgaggggtagcggtcgttgtccaccagggggtccactttttccacggtatgcaggcacatgtccccctcctccgcatccaagaaggtgattggcttgtaggtgtaggccacgtgacccggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatactcgcgcgcgacacacttccattcgggaaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgccgggacagagttccttgtcaaaataatcgatttttgaggatgcatcatccaaggccatctgccactcgcgggcggccattgctcgctcgtaggggttgaggggcggaccccagggcatgggatgcgtgagcgcggaggcgtacatgccgcatatgtcatagacatagatgggctccgagaggatgccgatgtaggtgggataacagcgccccccgcggatgctggcgcgcacatagtcatacaactcgtgcgagggggccaagaaggcggggccgagattggtgcgctggggctgctcggcgcggaagacgatctggcgaaagatggcatgcgagtttgaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgtctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttttttgagagggggttaggcagagcgaaagtgacgtcattgaagagaatcttgcctgctcgcggcatgaaattgcgggtgatgcggaaagggccaggcacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcctgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggccgtgtccacgcattgcatgagcccgtagctgcgcggggccacgaccgtgccgcggtgcgcttttagaagcggtgtcgcggacgcgctcccggcggcagcggcggttccggtcccgcgggcaggggcggcagaggcacgtcggcgtggcgctcgggcacgtcccggtgctgcgccctgagagcgctggcgtgcgcgacgacgcggcggttgacatcctgaatctgccgcctctgcgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcgttggagatgcgacccatgagctgcgagaaggcgcccaggccgctctcgttccagacgcggctatagaccacgtccccgtcggcgtcgcgcgcgcgcatgaccacctgcgcgaggttgagctccacgtgccgcgcgaagacggcgtagttgcgcaggcgctggaataggtagttgatggtggtggcgatgtgctcggtgacgaagaagtacatgatccagcggcgcaggggcatctcgctgatgtcgccaatggcctccagcctttccatggcctcgtagaaatccacggcgaagttgaaaaactgggcgttgcgggccgagaccgtgagctcgtcttctaggagcctgatgagttcggcgatggtggcgcgcacctcgcgctcgaaatccccgggagcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattaaagtaggcgtttttgaggcggcggatggtggcgagcaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccatgagcgaccagttaacggtctgcaggccaggctgcacgacctccgagtacctgagccgcgagaaggcgcgcgagtcgaagacgtagtcgttgcaggtgcgcacgaggtactggtatccgactaggaagtgcggcggcggctggcgatagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctgaccggtgagacgcgcgcagtcattgacgctctagaggcaaaaacgaaagcggttgagcgggctcttcctccgtagtctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgccggccgaggggagtcgctagacttgaaagcggccgaaaaccccaccgggtagtggctcgcgcccgtagtctggagaagcatcgccagggttgagtcgcggcagaacccggttcgaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcaaccgcggccgtagcaggcgccggcgctagccagccacagacagagatggacttggaagagggcgaagggctggcgagactgggggcgccgtccccggagcgacacccccgcgtgcagctgcagaaggacgtgcgcccggcgtacgtgcctccgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaatccggacagcaagcctctgacggcgcagctgttcctggtggtgcagcacagcagggacaacgaggcgttcagggaggcgctgctgaacatcgccgagcccgagggccgctggctgctggagctgattaacatcttgcaaagcattgtagtgcaggagcgcagcctgagcctggccgagaaggtggcggcgatcaactactcggtgcttagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtcagcacgagccggcggcgcgagctgagcgaccgcgagctgatgctgagcctgcgccgggcgctggtagggggcgccgccggcggcgaggagtcctactttgacatgggggcggacctgcattggcagccgagccggcgcgccttggaggccgcctacggtccagaggacttggatgaggatgaggaagaggaggaggatgcacccgttgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcgcaccaaccccacgcacgagaaggtgctggcgatcgtgaacgcgctggcggagaacaaggccatccgtcccgacgaggccgggctggtgtacaacgccctgctggagcgcgtgggccgctacaacagcacgaatgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattataccaactttatcagcgcgctgcggctgatggtgaccgaggttccccagagcgaggtgtaccagtctggcccggactactttttccagactagcagacagggcctgcagacggtgaacctgagccaggctttcaagaacctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggtcacctgctgacgctgtaccgcgaggccataggccaggcgcaggtggacgagcagaccttccaggagatcactagcgtgagccgcgcactgggtcaaaacgacaccgacagtctgagggccaccctgaacttcttgctgaccaatagacagcagaagatcccggcgcagtacgcgctgtcggccgaggaggagcgcatcttgagatatgtgcagcagagcgtaggacttttcttgatgcaggagggggccacccccagcgccgcgctggacatgaccgcgcgcaacatggaacctagcatgtacgccgccaaccggccgttcatcaataagctgatggactacttgcaccgcgcggcggccatgaactcggactactttacaaacgccatcctgaacccgcactggctcccgccgccggggttctacacgggcgagtacgatatgcccgaccccaacgacgggttcctgtgggacgacgtggacagcgcggtgttctccccgaccttgcaaaagcgccaggaggcggtgcgcacgcccgcgagcgagggtgcggtgggtcggagcccctttcctagcttagggagtttgcatagcttgccgggctcggtgaacagcggcagggtgagccggccgcgcttgctgggcgaggacgagtacctgaacgactcgctgctgcagcccccgcgggtcaagaacgccatggccaataacgggatagagagtctggttgacaaactgaaccgctggaagacctacgctcaggaccatagggagcctgcgcccgtgccgcggcgacagcgtcacgaccggcagcggggcctggtgtgggacgacgaggactcggccgacgatagcagcgtgttggacttgggcgggagcggtggggccaacccgttcgcacatctgcagcccaaactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacacaaacatgcccaatgtgaacgagtacatgttcaccagcaagtttaaggcgcgggtgatggtggctagaaaaaaggcggaaggggctgatgcaaatgatagaagcaaggatatcttagagtatgaatggtttgagtttaccctgcccgagggcaacttttccgagaccatgaccatagacctgatgaacaacgccatcttggaaaactacttgcaagtggggcggcaacatggcgtgctggagagcgatatcggagtcaagtttgacagcaggaatttcaagctgggctgggacccggtgaccaagctggtgatgccaggggtctacacctacgaggccttccacccggacgtggtgctgctgccgggctgcggggtggactttaccgagagccgcctgagcaacctcctgggcattcgcaagaagcaacctttccaagagggcttcagaatcatgtatgaggatctagaagggggcaacatccccgctctgcttgatgtggaagcatacctcaacagcaagaatgataaggaggaggctaccaagaatgcaaacagagatgctgacaatggaggtggtgaaactaggggagatacttttctcaccaccgaacagctaagagctgctggcaaggagctggttattaagcccatcaaggaagatgctagcaagaggagctataatgtcatagatggcacccatgacaccctgtaccgaagctggtacctgtcctatacctacggggaccccgagaagggggtgcagtcgtggacgctgctcaccaccccggacgtcacctgcggcgcggagcaagtctactggtcgctgcctgacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacttccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctatccagtcgcaccttctaaaaaatgtctattctcatctcacccagcaataacaccggctggggtattactaggcccagcaccatgtacggaggagccaagaagcgctcccagcagcaccccgtccgcgtccgcggccacttccgcgctccctggggcgcttacaagcgcgggcggactcccgccgccgccgtgcgcaccaccgttgacgacgtcatcgactcggtggtcgccgacgcgcgcaactacacccccgccccctccaccgtggacgcggtcatcgacagcgtggtggccgacgctcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgccgccactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgggtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagtttgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagaacatgtacccgaccatgcagatcatggtgcccaagcgccggcgcgtggaggaagtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggcttccagcctccaccgctaccgtctccacttctaccgccgccacggctaccgagcctcacaggaggcgaagatggggcgccgccagccggctgatgcccaactacgtgttgcatccttccattatcccgacgccgggctaccgcggtacccgatattacgccagccgcaggcgcccagccaccaagcgccgccgccgcaccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacggcctggcctcgggcattaacggggtggtggacatcgcgaaccaggccgtgcagcgcgagataaacagccgcctggacccgcggccgcccacggtggtggagatggaagatgcaactcctccgccgcccaagggcgagaagcggccgcggcccgatgcggaggagacgatcctgcaggtggacgagccgccctcgtacgaggaggccgtcaaggccggcatgccaaccacgcgcatcatcgcgccgctggccacgggtgtaatgaaacccgccacccttgacctgcctccaccacccacgcccgctccaccaaaggcagctccggttgtgcagccccctccggtggcgaccgccgtgcgccgcgtccccgcccgccgccaggcccagaactggcagagcacgctgcacagtatcgtgggcctaggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggccccaaagagcgcccccaatccaagtcagtggaccgccaatgaaaaacaaactggcggccaaccaaaatctgttacccaaacatttggatctgctccaatgggaggcagcaatattactattgaaggattggttattggaactaaggaggaagaaggcaatgccactgaagaaatattcgcagataaaacattccagccagaacctcaagtaggagaagaaaactggcaggaaacagaagccttctatggaggaagggctcttaaaaaggataccaaaatgaaaccatgttacggttcatttgctagacccaccaatgaaaaaggagggcaagcaaaattaaagctcaacgatcagggtcagccaactaaagattatgacatagacctggcattctttgatactccgggcggaacacctccaacaggcagtggtcaacaggaagaatacaaagcagacattgttatgtacactgaaaatgtcaaccttgaaaccccagacacccacgtggtatataagccaggaaaagaggatgagagttctgaaataaatttgacacagcagtccatgcccaacagacctaactacattggctttagggacaactttgtggggctcatgtattacaacagcaccggcaatatgggtgtgctggctggtcaggcttctcagttgaacgctgtggtcgacttgcaagacagaaataccgagctatcttaccagctattgctagattctctgggcgacaggaccagatactttagcatgtggaactctgcggtggacagctatgatcccgatgtcaggatcattgagaatcacggtgtggaagatgaacttccaaactattgcttcccattgaatggtactggcaccaattccacttatcaaggcgtaaaggtgaaaacaggtcaggatggagctgaggagaccgagtgggaaaaagatgaaactgttgcaagacaaaatcaaatcgccaagggcaacgtctatgccatggagatcaacctccaggccaacctgtggaagagttttctgtactcgaacgtagccctgtacctgcctgactcatacaagtacacgccggccaacgtcacgctgcccgccaacaccaacacctacgagtacatgaacggccgcgtggtagccccctcgctggtggacgcctacatcaacattggcgcccgctggtcgctggaccccatggacaatgtcaaccccttcaaccaccaccgcaacgcgggcctgcgctaccgctccatgcttctgggcaacggacgctacgtgcccttccacattcaagtgccccaaaagttctttgccatcaagaacctgctcctgctacccggctcctacacctacgagtggaacttccgcaaggatgtcaacatgatcctgcagagttccctcggaaacgacctgcgcgtcgacggcgcatccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccgtctgaaaaccaaggaaactccctccctcggctcgggttttgacccctactttgtctactcgggctccatcccctacctcgacggaaccttctacctcaaccacaccttcaagaaggtttccatcatgttcgactcctcggtcagctggcccggcaacgaccggctgctcacaccgaacgagttcgagatcaagcgcagcgtcgacggggagggctacaacgtggcccaatgcaacatgaccaaggactggttcctcgtccagatgctttcccactacaacatcggttaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctagcacccaccatgcgccaggggcagccctaccccgccaacttcccctacccgctcatcggctccaccgcagtcccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacacccttctccgccggcaacgccaccacataagcatgagcggctccagcgaaagagagctcgcggccatcgtgcgcgacctgggctgcgggccctactttttgggcacccacgacaagcgcttccctggcttcctcgccggcgacaagctggcctgcgccatcgtcaacacggccggccgcgagaccggaggcgtgcactggctcgccttcggctggaatccgcgctcgcgcacctgctacatgttcgacccctttgggttttcggaccgccggctcaagcagatttacagcttcgagtacgaggccatgctgcgccgcagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactccccttactttcgctcccaccgcgccgccatcgaacatgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggatgccacttgaactcggggatcaccagtttgggaacagcgatctcggggaaggtttcgctccacatgcgccggctcatttgcagggcgcccagtatgtcaggcgcggagatcttgaaatcgcagttgggaccggtgctctgcgcgcgcgagttgcggtacacggggttgcagcactggaacaccatcagactggggtgcttcacgctggccagcacgctcttgtcgctgatctgatccttgtccaggtcctcggcgttgctcaggccgaacggggtcatcttgcacagctggcggcccaggaagggcacgctctgaggcttgtggttacactcgcagtgcactggcatcagcatcatccccgcaccgcgctgcatattcgggtagagggccttaacaaaggccgagatctgcttgaaagcttgctgggccttggccccctcgctgaagaacagcccgcagctcttcccactgaactggttatttccgcacccggcatcctgcacgcagcagcgcgcgtcatggctggtcagttgcaccacgctacgtccccagcggttctgggtcaccttggccttgctgggctgctccttcaacgcgcgctggccgttctcgctggtcacatccatctccaccacgtggtccttgtggatcatcaccgtcccgtgcagacacttgagctggccttccacctcggtgcagccatggtcccacagggcgcagccggtgcactcccagttcttgtgcgcgatcccgctgtgactgaagatgtaaccttgcaacatgcggcccatcacggtgctaaatgatttactggtgctgaaggtcagttgcaggccgcgggcctcctcgttcatccaggtctgacacatcttctggaagatctcggtctgctcgggcattagcttgtaggcatcgcgcaggccgctgtcgacgcggtagcgttccatcagcacgttcatggcatccatgcccttctcccaggacgagaccagaggcagactcagggggttgcgcacgttcaggacaccgggggtcgcgggctcgacgatgcgttttccgtccttgccttccttcaacagaaccggaggctggctgaatcccactcctacgatcacggcatcttcctggggcatctcttcgtcggggtctaccttggtcacatgcttggttttcctgggttgcttcttttttggagggctgtccaccgggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgaacaacccaaaatcgagcaggacctgggcttcgaagagccggctcgtctagaaaccccacaggatgaacaggagcacgagcaagacgcaggccaggacgagaccgacgctgggctcgagcatggctacctagaggaggacatgctgctgaaacacctgcagcgccagtccctcatcctcagggacgccctggccgaccggagcgagacccccctcagcgttgaggagctaagtcgggcctacgagctcaaccttttctcgccgcgcgtgccccccaaacgccagcccaacggcacctgcgagcccaacccgcgtctcaacttctaccccgtcttcgcggtccccgaggcccttgccacctatcacatctttttcaagaaccaaaagatccccgtctcctgtcgcgccaaccgcacccgcgccgacgcgctcctagctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggtgacaacgccaggctggccgtgctcaagcgcagcgtcgagctcacccacttcgcctaccccgccgtcaacctcccgcccaaggtcatgcgtcgcatcatggatcagctcatcatgccccacatcgaagccctcgatgaaagtcaggaacagcggcccgaggacgcccagcccgtggtcagcgacgagcagctcgcgcgctggctcgggacccgcgacccccaggccctggagcagcggcgcaagctcatgctggccgtggtcctggtcaccctcgagctggaatgcatgcgccgcttcttcaccgaccccgacaccctgcgcaaggtcgaggagaccctgcactacactttcaggcacggtttcgtcaggcaggcctgcaagatctccaacgtggagctgaccaacctggtctcttgcctggggatcctgcacgagaaccgcctggggcagaccgtgcttcactctaccctcaagggcgaggcgcggcgggactacatccgcgactgcgtctttctctttctttgccatacatggcagtcggccatgggtgtgtggcagcagtgtctagaggacgagaacctgaaggagctggacaagcttcttgctagaaatcttaaaaagctgtggacgggcttcgacgagcgcaccgtcgcctcggacctggccgagatcgtcttcccagagcgcctgaggcagacgctgaaaggcggactgcccgacttcatgagccagagcatgttgcaaaactaccgcactttcattctcgagcgatctgggatgctgcccgccacctgcaacgctttcccctccgactttgttccactgagctaccgcgagtgtcccccgccgctgtggagccactgctacctcttgcagctggccaactacatctcctaccactcggacgtgatcgaggacgtgagcggcgaggggcttctcgagtgccactgccgctgcaacctgtgctccccgcaccgctccctggtctgcaacccccagctcctaagcgagacccaggtcattggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgcccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccactagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggtgacggtaagcacgagcggcagggctaccgatcatggaggtcccacaaagccgcgatcatcgcctgcttgcaagactgcggggggaacatcgctttcgcccgccgctacctgctgttccaccgcggagtaaacatcccccgcaacgtgttgcattactaccgtcaccttcacagctaagaaaaaatcagaagtaagaggagtcgccggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaattggctaagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgctttgcccgggagagctgcggactcatctactttgagtttcccgaggagcaccccaacggccctgcgcacggagtgcggatcaccgtagagggcaccaccgagtctcacctggtcaggttcttcacccagcaacccttcctggttgagcgggaccggggcgccaccacctacaccgtctactgcatctgtcctaccccgaagttgcatgagaatttttgctgtactctgtgtgctgagtttaataaaagctgaaatcagactctactctggaatccagtgtcgtcataacatcacaaagaccatcaacttcaccaccgaagaacaggtaaactttacctgcaaaccacacaagaagtacatcatctggttatatcagaactctactctagctgtagccaacacctgctcgaacgacggtgttcttctaccaaacaacctcacaagtggacttaccttctctgttagaagggcaaagctaattctctatcgccctatcttagaaggaacttaccattgtcacagcggaccttgtcaccacattttccatttggtgaacgtcaccagcagcagcaacagctcagaaactaacctctctcgtactaacagacctcaattcggaggtgagctaaggcttcccccttctgaggagggggttagcccatacgaagtggtcgggtatttgattttaggggtggtactgggtgggtgcatagcggtgctagctcagctgccttgctgggtggaaatcaaaatctttatatgctgggtcagacattgtggggaggaaccatgaatgggctcttgctgattatcctttccctggtggggggtgtactgtcatgccacgaacagccacgatgtaacatcaccacaggcaatcatatgagcagagagtgcactgtagtcattaaatgcgagcacgactgcccactaaacattacattcaagaataacaccatgggaaatgtatgggtgggtttctgggaaccaggagatgagcagaactacacggtcactgtccatggtagcaatggaaatcacactttcggtttcaaattcatttttgaagttatgtgtgatatcacactgcatgtggctagacttcatggcttgtggccccctaccaaggagaacatgattgggttttctttggcttttgtgatcatggcctgcttgatgtcaggtctgctggtaggggctttagtgtggttcctcaaacgcaagcccaggtatggaaatgaggagaaggaaaaattgctataaattctttttcttttcacagcaccatgaatactttgaccagtgtcgtgctgctctctcttcttgtagcttttagtcaggcaggaattattaacttaaatgtatcatggggaatgaatctaactttagtgggaccatcagacctaccagttacatggtatgacggaaagggaatgcagttttgtgatggaaatacaattaagaacccacaaatcaagcatagctgtgatcaacagaatctaactttacttaatgctgacaagtctcatgaaaggacttacctaggttacagacatgacagtaagggaaaagtagactataaggttacagtcataccacctcctccaaccactcgcaagcctttgtcagagcctcattatgttactgtaactatgggctataacataactttagtgggaccctcagacctgccagttacatggtatgatggagaaggaaataaattctgcgatggagaaaaagttgaacatgcagaatttaatcatacatgtaacatccagaacctgacactgctttttgtcaacttaacgcataatggagcatacattggttataacaaagacggttctgatagagaattatatgaggtgtcagtcaaaaccttgtttcagaacggggctggacaaagtaaggttgaacaaggtaataaatggaaaactaataccactcaaagtggtggtaaaaaaaccaaaacagatcatagaaaccagagtccaaaaagaaaatcaacaaataatcttcaaccaacacaattgtatgttagaccttttactaatgttagtttaactggacctccaaatggcaaggttacttggtatgacggcgaacttaatgatccatgtgaacaaaagtacaaactcagaactttttgcaatcagcaaaatctaactttaattaatgtaaccagcacttatgatggcatctattatggcactgatgaaaaagataaggcaaatcgttacagaataaaagtaaatactacaaatcacaaaactgttaaaattaagccacataccagagaacctcctgctaaacaagaaaaacagtttgaattacaaactgcagaaactgatgaaaacgaatcaaaaattccatcaactactgtggcaatcgtggtgggagtgattgcgggctttgtaactctaatcattgtcttcatctgctacatctgctgccgcaagcgtcccaggtcatacaatcatatggtagacccactactcagcttctcttactgaaactcagtcactctcatttcagaaccatgaaggctttcacagcttgcgttctgattagcttattcacacttagttcagctggttatattcaagttaatgtgactagaggtggaaacattacattaaatggaccactacaaaatactacatggttaagataccacctaaatggttggcaacatatttgtacatggtctggtccatcatataagtgccatactaataatggaagcattacaatttttgctattaacatcacttctggaacttataaagccgaaggatataaaaaagaggttaggactttttcatctaaaaatcaaagacatacaattgaagattctggtgattatgaggaacataaaatacttttgtataatttaacaatatttgaactgccaaccactaaagcacccaccacagttaggacaactagggaaacaactgcacagcctactacaaatcccaccactcagacaactactagtccaacaacacagcccactacaattacaactagggaggtaactactcacactacacagttagacactacagtgcagaatagtactgtgttaatcaggtttttgttgagggaggaaagtactactgaacagacagaggctacctcaattgccttcagcagcactgcaaatttaacttcgcttgcttcaataaatgaaaccatcgtgccgatgatgctggaacaagatttaagaggtttggatatgcaaatcacttttctggttgtctgtggaatctttattctcgctgtccttctctactttgtctgctgcaaggccagagagaaatctaggcggcccatctacaggccagtaatcggggaacctcagcccctccaagtggacggaggcttaagaaatcttctcttctcttttacagtatggtgatcagccatgattcctaggttcttcctatttaacatcctcttctgtctcttcaacatctgcgctgcctttgcggccgtctcgcacgcatcgcccgactgtctcgggcccttccccacctacctcctctttgccctgctcacctgcacctgcgtctgcagcattgtctgcgtggtcattaccttcctgcagcttatcgactggtgctgcgcgcgctacaattacctacaccacagtcccgaatacagggacgagaacgtagccagaatattaaggctcatctgactatgcagactctgctcatactgctatccctcctatcccctgtccttgctgctaaagactattctcaatgtaaatttgcggacatatggaatttcttagactgctatgatgcgaaaattgatatgccctcctattacttggtaattgtgggaatagtcatggtctgctcctgcactttctttgccatcatgatatacccctgttttgatctcggctggaactctgttgaggcattcacatacacactagaaagcagttcactagcttccacgccaccacccacaccgcctccccgcagaaatcagtttccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggaatcttctgcctggtcaaacaggcaaagattacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctccttaagaccctttgcggactccgcgacctcctccccatgaactgatgttgattaaaatcccaaaaaccaatcagcccatttccccatccccatttactcaagaataaattattggaactattcattcaataaagatcacttacttgaaatctgaaagtatgtctctggtgtagttgtttagcagcacctcggttccctcctcccagctctggtactccagtccccggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaacatccccttcctcactcccccctttgtatcctccgatggattcaaaaacttcccccctggggtcctgtcgctcaaactagctgacccaatagccatcgtcaatggggatgtctcactcaaagtgggagggggtctcactttgcaagatggaactggaaaactaacagtcaatactgaaccacctttgcaacttgcaaacaacaaattagggattgctttggacgctccatttgatgttatagataataaactcacaatgttagcaggccatggcttgtctattataacaaaagaaacatcaacattgcctggcttagttaatactcttgtagtattaactggaaagggtattggaacagaatcaacagataatggtggaagcgtatgtgtgagagttggagaaggtggcggcttatcatttaataatgatggagacttggtagcatttaataaaaaagaagataagcgcaccctatggacaactccagacacatctccaaattgcaagattgatcaggataaggactctaagttaactctggtccttacaaagtgtggaagtcaaatattggctaatgtgtcattaattgtcgtagctggtaagtacaaaattatcaataacaatactcaaccatctctcaaaggatttaccattaaattattgtttgatcaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtaaatgttgaatttgaaacaacctcttttaccttttcctatatcgcccaagaatgaaaggtcaataaacgtgtttttcatttgaaaatttcatgtatctttattgatttttacaccagcacgagtagtcagtctcccaccaccagcccatttcacagtgtacacggttctttcagcacgggtggccttaaataggggaatgttctgattagtgcgggaactgaacttggggtctataatccacacagtttcctggcgagccaaacgggggtcggtgattgagatgaagccgtcctctgaaaagtcatccaagcgggcctcacagtccaaagtcacagtctggtggaatgagaagaacgcacagattcatactcggaaaacaggatgggtctgtgcctctccatcagcgccctcagcagtctctgccgtcggggctctgtgcggctgctgcatatgggatcgggatcgcaagtctctctgactataatccccacagccttcagcatcagtctcctggtgcgtcgggcacagcaccgcatcctgatctctgccatgttctcacagtaagtgcagcacataatcaccatgttattcagcagcccataatttagggcgctccagccaaagctcatgttggggatgatggaacccacgtgaccatcgtaccagatgcggcagtatatcaagtgcctgcctctcatgaacacactgcccatgtaca

SEQ ID NO: 1440 - DNA, 32767 bp, Human adenovirus 64
catcatcaataatataccccacaaagtaaacaaaagttaatatgcaaatgagcttttgaattttaacggttttggggcggagccaacgctgattggacgagaagcggtgatgcaaataacgtcacgacgcacggctaacggccggcgcggaggcgtggcctaggccggaagcaagtcgcggggctaatgacgtataaaaaagcggactttagacccggaaacggccgattttcccgcggccacgcccggatatgaggtaattctgggcggatgcaagtgaaattaggtcattttggcgccaaaactgaatgaggaagtgaaaagtgaaaaatacctgtcccgcccagggcggaatatttaccgagggccgagagactttgaccgattacgtggggtttcgattgcggtgtttttttcgcgaatttccgcgtccgtgtgaaagtccggtgtttatgtcacagatcagctgatccacagggtatttaaaccagttgagcccgtcaagaggccactcttgagtgccagcgagtagagatttctctgagctccgctcccaaagtgtgagaaaaatgagacacctgcgcctcctgtcttcaactgtgcctattaacatggccgcattattgctggaggactatgtgagtacagtattggaggacgaactacatccatctccatttgagctgggacctacacttcaggacctttatgatttggaggtagatgcccatgatgacgacccaaacgaagaggctgtgaatttaatatttccagaatctctgattcttcaggctgacatagccagcgaagctgtacctacaccacttcatacaccgactttgtcacccatacctgaattggaagaggaggacgagttagacctccgatgttatgaggaaggttttcctcccagcgattcagaggacgaacagggtgagcagagcatggctctaatctcagaatatgcttgtgtggttgtggaagagcattttgtgttggacaatcctgaggtgcccgggcaaggctgtagatcctgccagtaccaccgggataagaccggagacacaaacgcctcctgcgctctgtgttacatgaaaaagaacttcagctttatttacagtaagtggagtgaatgtgagagaggctgagtgcttaacacataactgggtgatgcttaaacagctgtgctaagtgtggtttatttttgtttctaggtccggtgtcagaggatgagtcatcgccctcagaagaaaaccacccgtgtccccctgagctgtcaggcgaaacgcccctgcaagtgcacaaacccaccccagtcagacccagtggcgagaggcgagcagctgttgaaaaaattgaggacttgttacatgacatgggtggggatgaacctttggacctgagcttgaaacgccccaggaactaggcgcagctgtgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgactggtgtacacagttaagaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctgaattgaatcaggtatccagcttgtacccagagcttagcaaggtgctgacatccatggctaggggagtgaagagggagaggagcgatgggggcaataccgggatgatgaccgagctgacggccagcctgatgaatcgcaagcgcccagagcgcattacctggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcagggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgctggatgggcgtggtcggaagacctaagagcgagatgtctgtgaagcagtgtgtgtttgagaaatgctacctgggagtctctaccgagggcaatgctagagtgagacactgctcttccctggatacgggctgcttctgcctggtgaagggtacggcctctctgaagcataatatggtgaagggctgcacagatgagcgcatgtacaacatgctaacatgcgactcgggggtctgtcatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggaaaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaatgtgagtataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcgcttgacagcaccgccgcagccgcggcagccgcagccgccatgacagcgacgagactggcctcgagctatatgcccagcagcggtagcagcccctctgtgcccagttccatcatcgccgaggagaaactgctggccctgctggccgagctggaagccctgagccgccagctggccgccctgacccagcaggtgtccgatctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagataatccagtcatagcaggggcgctgggcgtggtgctggatgatgtccttgaggaggagactgatggccacggggagccccttggtgtaggtgttggcaaagcggttaagctgggagggatgcatgcggggggagatgatgtgcagtttggcctggatcttgaggttggcgatgttgccacccagatcccgccgggggttcatattgtgcaggaccaccagaacggtgtagcccgtgcacttggggaacttatcatgcaacttggaagggaatgcgtggaagaatttggagacgcccttgtgcccgcccaggttttccatgcactcatccatgatgatggcaatgggcccgtgggctgcggctttggcaaaaacgtttctggggtcagagacatcataattatgctcctgggtgagatcatcataagacattttaatgaatttggggcgaagggtgccagattgggggacgatcgttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttcttaacagctgggacttgccgcacccggtcgggccgtagatgaccccgatgacgggttgcaggtggtagttcaaggagatgcagctgccgtcgtcccggaggaggggggccacctcgttgagcatgtctctcacttggaggttttcccggacgagctcgccgaggaggcggtccccgcccagcgagagcagctcttgcagggaagcaaagtttttcaggggcttgagcccgtcggccatgggcatcttggcaagggtctgcgagaggagctccaggcggtcccatagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagcttgtagttaagggcctcggcggcgtggcccttggcacggagcttgcctttggaagagcgcccgcaggcgggacagaggagggattgcagggcgtagagcttgggtgcgagaaagacggactcgggagcgaaggcgtccgctccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgttcggtgacaaacaggctgtctgtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcaatgctttttaggagactttcatccatctggtcagaaaagactatttttttattgtcaagcttggtggcaaaggagccatagagggcgttggagagaagcttggcgatggatctcatggtctgatttttgtcacggtcggcgcgctccttggccgcgatgttgagctggacatactcgcgcgcgacacacttccattctgggaagacggtggtgcgctcgtcgggcacgatcctgacgcgccagccgcgattatgcagggtgaccaggtccacgctggtggccacctcgccgcgcaggggctcgttggtccagcagaggcgtccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgcgtgagggcggaggcgtacatgccgcagatgtcgtagacatagatgggctccgagaggatgccgatgtaggtgggataacagcgccccccgcggatgctggcgcgcacatagtcatacaactcgtgcgagggggccaagaaagcggggccgagattggtgcgctggggctgctcggcgcggaagacgatctggcgaaagatggcatgcgagttggaggagatggtgggccgttggaagatgttaaagtgggcgtggggcaagcggaccgagtcgcggatgaagtgcgcgtaggagtcttgcagcttggcaacgagctcggcggtgacaaggacgtccatggcgcagtagtccagcgtttcacggatgatgtcataacccgcctcttctttcttctcccacagcgcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtatccctaaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccggaacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaatgaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggtcgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaaaacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcagtggcggtagaggcacgtcggcgtggcgctcgggcaggtcccggtgctgcgccctgagagcgctggcgtgcgcgacgacgcggcggttgacatcctggatctgccgcctttgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatttcctcctcctggagatcgccgcggcccgcgcgctctacggtggcggcaaggtcattcgagatgcgacccatgagctgcgagaaggcgcccaggccgctctcgttccagacgcggctgtaaaccacgtccccgtcggcgtcgcgcgcgcgcatgaccacctgcgcgaggttgagctccacgtgccgcgtaaagacggcgtagttgcgcaggcgctggaagaggtagttgagggtggtggcgatgtgctcggtgacgaagaagtacataatccagcggcgcaggggcatttcgctgatgtcgccaatggcctccagcctttccatggcctcgtagaaatccacggcgaagttgaaaaactgggcgttgcgggccgagaccgtgagctcgtcttccaggagcctgatgagttcggcgatggtggcgcgcacctcgcgctcgaaatcccagggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggtgggtccccgttgggcagcgatagggcgctgacaatgcatcttatcaattgcggtgtagggcacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgaacggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccataagcgaccagttgacggtctgcaggccgggttgcacgacctcggagtacctgagccgcgagaaggcgcgcgagtcgaagacatagtcgttgcaggtgcgcacgaggtactggtatccgactagaaagtgcggcggcggctggcggtagagcggccagcgctgggtggccggcgcgcccggggccaggtcctcaagcatgagtcggtggtagccgtagaggtagcgggacatccaggtgatgccggcggcggtggtggaggcgcgcgggaactcgcggacgcggttccagatgttgcgcaggggcaggaaatagtccatggtcggcacggtctggccggtgagacgcgcgcagtcattgatgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgtcggccgaggggagtcgctagacttgaaagcggccgaaaaccctgccgggtagtggctcgcgcccgtagtctggagaagcatcgccagggttgagtcgcggcagaacccggttcaaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacagcctacgagcagacggtgaagcaggaacgcaactttcaaaagagtttcaacaaccacgtgcgcaccctgatcgcgcgcgaggaggtggccctgggcctgatgcacctgtgggacctggcggaggccattgtgcagaacccggacagcaagcctctgacggcacaactgttcctggtggtgcagcacagcagggacaacgaggcgttcagggaggcgctgctaaacatcgccgagcccgagggccgctggctgctggagctgatcaacatcttgcaaagcatcgtagtgcaggagcgcagcctgagcttggccgagaaggtggcggcgatcaactactcggtgctaagcctgggcaagttttacgcgcgcaagatttacaagacgccgtacgtgcccatagacaaggaggtgaaaatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctaagcctgcgccgggcgctggtaggtggcgccgccggcggcgaggagtcctacttcgacatgggggcggacctgcattggcagccgagccggcgcgccttggaggccgcctacggtccagaggacttggatgaggatgaggaagaggaggaggatgcacccgttgcggggtactgacgcctccgtgatgtgtttttagatgtcccagcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggccattctggaggcggtggtcccctctcggaccaaccccacgcacgagaaggtgctggcgatcgtgaacgcgctggcggagaacaaggctattcgtcccgacgaggctgggctggtatacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattataccaactttatcagcgcgctgcggctgatggtgaccgaggttccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggtcacctgctgacgctgtaccgcgaggccataggccaggcacaggtggacgagcagaccttccaggagatcactagtgtaagccgcgcgctgggtcagaacgacaccgacagtctgagggccaccctgaacttcttgctgaccaatagacagcagaagatcccggcgcagtatgcgctgtcggccgaggaggagcgcatcctgagatatgtgcagcagagcgtagggctgtttctgatgcaggagggggccacccccagcgccgcgctggacatgaccgcgcgcaacatggaacctagcatgtacgccgccaaccggccgtttatcaataagctgatggactacctgcaccgcgcggcgtccatgaactcggactactttaccaatgccattttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcacggtgggtcggagcccctttcctagcttagggagtttgcatagcttgccgggctcggtgaacagcggcagggtgagccggccgcgcttgctgggcgaggacgagtacctaaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcagagctggctccgctgtacgacaccactcgcgtgtacttggtggacaacaagtcggcggacatcgcttccctgaactaccaaaacgaccacagcaactttctgaccacggtggtgcaaaacaacgatttcacccccgccgaggctagcacgcagacgataaattttgacgagcggtcgcggtggggcggtgatctgaagaccattctgcacaccaacatgcccaatgtgaacgagtacatgtttaccagcaagtttaaggcgcgggtgatggtggctaggaaacacccacagggggtagaagcaacagatttaagcaaggatatcttagagtaccagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggaccccgtgaccaagctggtgatgccaggggtctacacctatgaggccttccacccggacgtggtgctgctgcctggctgcggggtggacttcaccgagagccgcctaagcaaccttctgggcattcgcaagaagcaacctttccaagagggcttcagaatcatgtatgaggatctcgaagggggcaacattcccgcacttctgaatgtgaccaagtacctggaaagcaagaagaagctagaggagaatgccgctaaggctaatggtcctgcaagaggagacagtagtgtctcaagagaggtggaaaaggcagctgaaaaagagcttgtcattgagcccatcaagcaagatgatagcaagagaagttacaacctcattgagggtacccatgacaccctgtaccgaagctggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcctttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaaacgctcccagcagcaccccgtccgcgtccgcggccactttcgcgctccctggggcgcatacaagcgcgggcggacttccaccgccgccgccgtgcgcaccaccgtcgacgacgtcatcgactcggtggtcgccgatgcgcgcaactatacccccgccccctccaccgtggacgcggtcattgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgctgccgccgccgcggccatctctagcatgaccagacccaggcgcggaaacgtgtactgggtgcgcgactccgtcacgggcgtgcgcgtgcccgtgcgcactcgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgtgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaaacccgtgaccctgcagcaggtgctgccccaggcggtgctgctgccgagccgcggggttaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggccaccgagcctcccaggaggcgaagatggggccctgccaaccggctgatgcccaactacgtgttgcatccttccatcatcccgacgccgggctaccgcggcacccggtactacgccagccgcaggcgcccagccagtaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagggaaaagctcaaagaccagaacttccagcaaaaggtggtggacgggctggcctcgggcattaacggggtggtggacatcgcgaaccaggccgtgcagcgcgagataaacagccgcctggacccgcggccgcccacggtggtggagatggaagatgcaactcctccgccgcccaagggcgagaagcggccgcggcccgacgcggaggagacgatcctgcaggtggacgagccgccctcgtacgaggaggccgtaaaggccggcatgcccaccacgcgcatcatcgcgccactggccacgggtgtaatgaaacccgccacccttgacctgcctccaccacccacgcccgctccaccgaaggcagctccggtagtgcagccccctccggtggcgaccgccgtgcgccgcgtccccgcccgccgccaggcccaaaactggcaaagcacgctgcacagtattgtgggcctgggagtgaaaagtctgaagcgccgccgatgctattgaaagagaggaaggaagacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccaacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgttctggaccgcggccccagcttcaaaccctactcgggcacggcttacaacagcctggcccccaagggcgcccccaattccagtcagtgggatgctcaagaaaaaaatggacaaggaggaaatgacatggttaccaaaactcacacatttggcgtggctgctatgggaggaacaaatattacaaaccagggtttgttaattggaactgaagaaacagccgataatcctccaaaggaaatctttgcagacaaattattccagccagaacctcaagtaggagaggaaaactggcaagacagcaatgcattctatggaggcagggctcttaagaaggaaactaaaatgaaaccatgctatggatcttatgctagaccaacaaacacaagtggcggacaggctaagcttaaaactggtgacaatatcgatcctaccaaggatttcgacatagatcttgctttcttcgatactcctggcggaaatcctccagcaggtggtagtggaacggaagaatacaaagcagatattgttatgtacactgaaaatgtcaaccttgaaacacctgacactcatgtggtgtacaaaccagccaaagaggatgaaagttctcaggccaacttggttcagcagtccatgcccaacagacccaactacattggcttcagagacaattttgtggggctcatgtattacaacagcactggcaacatgggagtgctggctggtcaggcctctcagttgaatgctgtggtggacttgcaagacagaaacacagagctgtcttaccagctcttgctagattctctgggtgacagaaccagatactttagcatgtggaactctgcggtggacagctatgatccagatgtcagaatcattgaaaatcacggtgtggaagatgagcttccaaactattgctttccattggatggctctggtaccaatgctgcctaccaaggtgtaaaggttcaagatggtgaagacggggataaagaaactgaatgggaaaaagataccaaagtcgcagatcgtaaccaactgtgcaagggtaacatcttcgccatggagatcaacctccaggccaacctgtggaagagttttctgtactcgaacgtggccctgtacctgcccgactcctacaagtacacgccggccaacatcacgctgcccgccaacaccaacacctacgagtacatgaacggccgcgtggtagccccctcgctggtggacgcatacgtcaacatcggtgcgcgctggtcgctggaccccatggacaacgtcaaccccttcaaccaccaccgcaacgcgggcctgcgctaccgctccatgcttctcggcaacggccgctacgtgcccttccacatccaagtgccccaaaagttctttgccattaagaacctgctcctgctccccggctcctacacctacgagtggaacttccgcaaggatgtcaacatgatcctgcagagttccctcggaaacgacctgcgcgtcgacggcgcctccgtgcgcttcgacagcgtcaacctctacgctaccttcttccccatggcgcacaacaccgcctccaccctggaagccatgctgcgcaacgacaccaacgaccagtcctttaacgactacctctcggccgccaacatgctctaccccataccggccaaggccaccaacgtgcccatctccatcccctcgcgcaactgggctgccttccgcggctggagtttcacccggctcaagaccaaggaaactccttcccttggctcgggtttcgacccctactttgtctactcgggctccatcccctacctcgacgggaccttctacctcaaccacaccttcaaaaaggtgtccattatgttcgactcctcggtcagctggcccggcaacgaccggctgctcacgccgaatgagttcgagatcaagcgcagcgtcgacggggagggctacaacgtggcccaatgcaacataaccaaggactggttcctcgtccagatgctctcccactacaacatcggctaccagggcttccacgtgcccgagggctacaaggaccgcatgtactcctttttccgcaacttccagcccatgagcaggcaggtggtggatgagatcaactacaaggactacaaggccgtcaccctgcccttccagcacaacaactctggcttcaccggctacctcgcacccaccatgcgtcaggggcagccttaccccgccaacttcccttacccgctcatcggctccaccgcagtcccctccgtcacccagaaaaagttcctctgcgacagggtcatgtggcgcatccccttctccagcaacttcatgtccatgggtgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacacccttctccgccggcaacgccaccacctaagcatgagcggttccagcgaacgagaactcgcggccatcgtgcgcgacctgggctgcgggccctactttttgggcacccacgacaagcgcttcccgggcttcctagccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgaacagtccacccagaccgtgcaggggcccgactccgccgcctgcggacttttttgttgcatgttcttgcatgcgttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactccccttacttccgatcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttggaaagccacttgaactcggggatcaccagtttgggcactggggtctcggggaaggtctcgctccacatgcgccggctcatctgcagggcgcccagcatgtcagggccggagatcttgaaatcacagttggggccggtgctctgcgcgcgcgagttgcggtacacggggttgcagcactggaacaccatcagactggggtacttcacactggcaagcacgctcttgtcgctaatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctgaagaacagaccgcagctcttcccgctgaactggttattcccgcacccggcatcatgcacgcagcagcgcgcgtcatggctggtcagttgcaccacgctccgtccccagcggttctgggtcaccttagccttgctgggctgctccttcagcgcgcgctgtccgttctcgctggtcacatccatctccaccacgtggtccttgtgaatcatcaccgttccatgcagacacttgagctgaccttccacctcggtgcagccgtgatcccacaggacgcagccggtgcactcccaattcttgtgcgcgatcccgctgtggctgaaaatgtaaccttgcaacaggcgacccataatggtgctaaatgatttctgggtggtgaatgtcagttgcatcccgcgggcctcctcgttcatccaggtctggcacatcttctggaagatctcggtctgctccggcatgagcttgtaagcatcgcgcaagccgctgtcgacgcggtagcgttccatcagcacgttcatggtatccatgcccttctcccatgacgagaccagaggcagactcagggggttgcgcacgttcaggacaccaggggtcgcgggctcgacgatgcgttttccgtccttgccttccttcaacagaaccggaggctggctgaatcccactcccacgatcacggcgtcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctaaaacccccacaggatgaacaggagcacgagcaagacgcaggccaggaggagaccgacgctgggctcgaacatggctacctgggaggagaggaggatgtgctgctaaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccatctcctgtcgcgccaatcgcactcgcgccgacgcgctcctcgctctggggcccggcgcgcgcatacctgatatcgcttccctggaagaggtgcccaagatcttcgaagggctcggtcgggacgagacgcgcgcggcaaacgctctgaaagaaacagcagaggaagagggttacactagcgccctggtagagttggaaggcgacaacgccaggctggccgtgcttaagcgcagcgtcgagctcacccatttcgcctaccccgccgtcaacctcccgcccaaggtcatgcgtcgcatcatggatcagctcatcatgccccacatcgaggcccttgatgaaagtcaggaacagcgccccgagaacgcccagcccgtggtcagcgacgagatgctcgcgcgctggctcgggacccgcgacccccaggccctggagcagcggcgcaagctcatgctggccgtggtcctggtcacccttgagctcgaatgcatgcgccgcttttttaccgaccccgagaccctgcgcaaggtcgaggagaccctgcactacactttcagacacggtttcgtcaggcaggcctgcaagatctccaacgtggagctgaccaacctggtctcctgcctggggatcctacacgagaaccgcttgggacagaccgtgctccactctaccctgaagggcgaggcgcggcgggactacatccgcgactgcgtctttctctttctctgccacacatggcaagcggccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggagggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacattgcccaccactcggatgtgatcgaggacgtgagcggcgaggggctgctcgagtgccactgtcgctgcaacctatgctccccgcaccgctccctggtctgcaacccccagctactgagcgagacccaggtcatcggtacctttgagctgcaaggtccgcaggagtccaccgctccgctgaaactcacgccggggttgtggacttccgcgtacctgcgcaaatttgtacccgaggactactacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagacttggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcgacagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggcctgaggatcgcgacgaacgagcccttgaccaccagggagctgaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctgactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggcttagtgccggcccctcgatgatctcacgggtcaacggggtccgtaaccatcgaaaccagatattgttgcagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggctcgccaggcctctacccggacgagtttataccgaacttcgacgcagtgagagaagcggtggacggctacgactgaatgtcctatggtgactcggctgagctcgctcggttgaggcatctggaccactgccgccgcctgcgctgctttgcccgggagagctacggcctcatctactttgagctgcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatttgtcctaccccgaagttgcatgagaatttttgttgtactctttgtggtgagtttaataaaagctaaactcttgcaatactctggaccttgtcgtcatcaactcaacgagaccgtctacctcaccaaccagactgaggtaaaacttacctgcagaccacacaagacctatatcatctggttcttcgagaacacctcatttgcagtctccaacactcactgcaacgacggtgttgaacttcccaacaacctttccagtggactgagttacaatacacgtagagctaagctcatcctctacaatccttttgtagagggaacctaccagtgccagagcggaccttgcttccacagttttactttggtgaacgttaccggcagcagcacagccgctccagaaactaaccttccttctgatactatcaaaccttgtttcggaggtgagctaaggcttcccccttctcaggagggggttagcccatacgaagtggtcgggtatttgattttaggggtggtcctgggtgggtgcatagcggtgctagctcagctgccttgctgggtggaaatcaaaatctttatatgctgggtaagacattgtggggaggaactatgaaggggctcttgctgattatcctttccctggtggggggtgtgctgtcatgccacgaacagccacgatgtaacatcaccacaggcaatgagaggaacgactgctctgtagttatcaaatgcgagcaccattgtcctctcaacattacattcaaaaataagaccatgggaaatgtatgggtgggattctggcaaccaggagatgagcagaactacacggtcactgtccatggtagcaatggcaatcacactttcggtttcaaattcatttttgaagtcatgtgtgatatcacactacatgtggctagacttcatggcttgtggccccctaccaaggataacatggtgggtttttctttggcttttgtgatcatggcctgcttgatgtcaggtctgctggtaggggctctagtgtggtttctgaaacgcaagcccaggtatggaaatgaagagaaggaaaaattgctataaattctttttctttttcgcagaaccatgaatacagtgaaccgtatcgtgctgctctctcttcttgtagcttttagtcaggcaggatttcatactatcaatgctacatggtgggctaatataactttagtgggacccccagacacaccagtcacttggtatgatactcaaggattgtggttttgcaatggcagtagagttaagaatcctcaaatcagacatacatgtaatgatcaaaaccttactttgatccatgtgaacaaaacttatgaaagaacatacatgggttataatagacaagggactaaaaaagaagactacaaagttgtagttataccacctcctcctgctactgtaaaaccacagccagagccagagtatgtgtttgtttatatgggagagaacaaaactctagaaggtcctccgggaactccagtcacatggtttaatcaggatggaaagaaattttgtgaaggagaaaaagttcttcatccagaatttaaccacacctgtgacaaacaaaaccttatactactgtttgtgaattttacacatgatggagcttaccttgggtacaatcatcaaggaacccagagaacacactatgaagttacagtattagatctttttccagattctggccaaatgaaaattgaaaatcatagtgaggaaacagagcaaaaaaatgatgaacatcataactggcagaaacagggtgggcaaaaacagggtgggcaaaaaacaaatcaaacaaaagttaatgacaggagaaaaacagcgcaaaaaagaccatcaaagctaaagccggcaactattgaggcaatgctggttacagtgactgccgggtctaacttaactttggttggacctaaagcagaaggaaaagttacttggtttgatggagatttaaaaagaccatgtgagcctaattacagactaagacacgaatgtaataatcaaaacttaactctgattaatgtaactaaagattatgagggaacttactatggtacaaatgacaaagatgagggcaaaaggtacagagtgaaagtaaatactacaaattctcaatctgtgaaaattcagccatataccagacaaactactcctgatcaagagcacaaatttgaattacagttcgaaactaatggaaattatgattcaaaaattccctcaaccactgtggcaatcgtggtgggtgtgattgcgggcttcataactctgatcattgtcttcatatgctacatctgctgccgcaagcgtcccagggcatacaatcatatggtagacccactactcagcttctcttactaagactcagtcactttcatttcagaaccatgaaggctttcacagcttgcgttctgattagcctagtcacacttagtgtagctattaaaaatcaatatcatgttcataatgttaccagagatggatatatcacattaaatgtaacaattgataatactacctggacaagatatcatttaaataagtggcatcaaatttgtacgtggtcagacccatcatacaaatgtcacagcaatggcagcattaccattcatgctttcaatattacttctggccagtacaaagctgaaagttttactaactggtttagatattacggtaatcataaacatgaaattcatatttttaacataactgtaattgagcatcctacaacaaaagcacccaccactgctaatacagctacatcaattaaatcaacaaccacacagcctactactagggagacaactcaacctaccaccacagtcagtacaactactgagaccactactcaaactacacagctagacacaacagtgcagaatagcactgtgttggttaggtatctgttgagggaggaaagtactactgaacagacagaggctacctcaagtgcctttagcagcactgcaaatttaacttcgcttgcttggactaatgaaaccggagtatcattgatgaatcatcagcctttctcaggtttggatattcaaattacttttctggttgtttgtgggatctttattcttgtggttcttctgtactttgtctgctgcaaagccagagagaaatctaggaggcccatctacaggccagtaatcggggaacctcagccactccaagtggaagggggtctaaggaatcttcttttctctttttcagtatggtgatcagccatgattcctaggttcttcctatttaacatcctcttctgtctcttcaacatctgcgctgcctttgcagccgtctcgcacgcctcgcccgactgtctcgggcccttcccaacctacctcctctttgccctgctcacctgcacctgcgtctgcagcattgtctgcctggtcatcaccttcctgcagcttatcgactggtgctgtgcgcgctacaattatctccatcacagtcccgaatacagggacaagaacgtagccagaatcttaaggctcatctgaccatgcagactctgctcatgctgctatccctcctatcccctgccctagccacttatgctgattactctaaatgcaaattcgcagacatatggaatttcttagattgctatcaggaaaaaattgatatgccctcctattacttggtgattgtgggaatagtcatggtctgctcctgcactttctttgccatcatgatttacccctgttttgatctcggctggaactctgttgaagcattcacatacacactagaaagcagttcactagcctccacgccaccacccacaccgcctcctcgcagaaatcagttccccctgatacagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgggccgccaaggagctccttgatgccatcaacatccaccagtgcaagaagggcatcttctgcctggtcaaacaggcaaagatcacctacgagctcgtgtccaacggcaaacagcatcgccttacctatgagatgccccagcagaagcagaagttcacctgcatggtgggcgtcaaccccatagtcatcacccagcagtcgggcgagaccaacggctgcatccactgctcctgcgaaagccccgagtgcatctactcccttctcaagaccctttgcggactccgcgacctcctccccatgaactgatgttgattaaaagcccagaaaccaatcagacccttcctcatttccccatcccaatactcataagaataaatcattggaattaatcattcaataaagatcacttacttgaaatctgaaagtatgtctctggtgtagttgctcagcaacacctcggtaccctcctcccagctctggtactccagtccccggcgggcggcgaacttcctccacaccttgaaagggatgtcaaattcctggtccacaattttcattgtcttccctcttagatgtcaaagaggctccgggtggaagatgacttcaaccccgtctacccctatggctacgcgcggaatcagaatatccccttcctcactcccccctttgtctcctccgatggattcaaaaacttcccccctggggtactgtcactcaaactggctgatccaatcaccattaccaatggggatgtatccctcaaggtgggaggtggtctcactttgcaagatggaagcctaactgtaaaccctaaggctccactgcaagttaatactgataaaaaacttgagcttgcatatgataatccatttgaaagtagtgctaataaacttagtttaaaagtaggacatggattaaaagtattagatgaaaaaagtgctgcggggttaaaagatttaattggcaaacttgtggttttaacaggaaaaggaataggcactgaaaatttagaaaatacagatggtagcagcagaggaattggtataaatgtaagagcaagagaagggttgacatttgacaatgatggatacttggtagcatggaacccaaagtatgacacgcgcacactttggacaacaccagacacatctccaaactgcacaattgctcaagataaggactctaaactcactttggtacttacaaagtgtggaagtcaaatattagctaatgtgtctttgattgtggtcgcaggaaagtaccacatcataaataataagacaaatccaaaaataaaaagttttactattaaactgctatttaataagaacggagtgcttttagacaactcaaatcttggaaaagcttattggaactttagaagtggaaattccaatgtttcgacagcttatgaaaaagcaattggttttatgcctaatttggtagcgtatccaaaacccagtaattctaaaaaatatgcaagagacatagtttatggaactatatatcttggtggaaaacctgatcagccagcagtcattaaaactacctttaaccaagaaactggatgtgaatactctatcacatttaactttagttggtccaaaacctatgaaaatgttgaatttgaaaccacctcttttaccttctcctatattgcccaagaatgaaagaccaataaacgtgtttttcatttgaaattttcatgtatctttattgatttttacaccagcacgagtagacagtctcccaccaccagcccattttacagtgtacacggttctctcagcacgggtagccttaaatagggaaatattctcattagtgcgggaattggacttggggtctataatccacacagtttcctggcgagccaaacgggggtcggtgattgaaataaagccgtcctctgaaaagtcatccaagcgggcctcacagtccaaggtcacagtctggtggaacaagaagaacgcacagattcatactcggaaaacaggatgggtctgtgcctctccatcagcgccctcagcagtctctgccgccggggctcggtgcggctgctgcaaatgggatcgggatcacaagtctctctgactatgatcccaacagccttcagcatcagtctcctggtgcgacgggcacagcaccgcatcctgatctctgccatgttctcacagtaagtgcagcacataatcaccatgttattcagcagcccataattcagggcgctccagccaaagctcatgttgggaatgatggaacccacgtgaccatcgtaccagatg

SEQ ID NO: 1441 - DNA, 32767 bp, Human adenovirus 63
catcatcaataatataccccacaaagtaaacaaaagttaatatgcaaatgagcttttgaattttaacggttttggggcggagccaatgctgattggccgagaagcggtgatgcaaatgacgtcacgacgcacggctgacggtcgccgcggaggcgtggcctagcccggaagcaagtcgcgtggctgatgacgtataaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgcctcctgcctgaaactgtgcctatggacatggctgtgcttctactggatgactttgtgaatacagtattggaggatgaactgcatccaactccgtttgagctgggacccacacttcaggacctatatgatctggaggtagatgcccatgatgacgacccgaacgaagaggctgtgaatttaatatttccagaatctatgattcttcaggctgacatagccaacgaatctatacctactccacttcatacaccgactctgtcacccatacctgaattggaagaggaggacgaactagacctccggtgttatgaggaaggttttcctcccagcgattcagaggacgaacagggtgagcagagcatggctataatctcagactatgcttgtgtggttgtggaagagcattttgtgttggacaatcctgaggtgcccgggcaaggctgtagatcctgccaatatcaccgggatcagaccggagacccaaatgcttcatgcgctctgtgttacatgaaaaagactttcagctttatttacagtaagtggagtgaatgtgagagaggctgagtgcttaacacataactgtaatgcttgaacagctgtgctaagtgtggtttatttttgttactaggtccggtgtcagaggatgagtcatcgccctcagaagacgaccacccgtcttcccccgatctcacagatgacacgcccctgcaagtgatcagacccaccccagtcagactcagtggggagaggcgaatggctgttgacaaaatcgaggacttgttgcaggacatgggtggggatgaacctttggacctgagcttgaaacgccccaggaactaggcgcagctgtgctgagtcatgtgtaaataaagttgtacaataaaagtatatgtgacgcatgcaaggtgtggtttatgactcatgggcggggcttagtcctatataagtgctaacacctgggcacttaggcacagaccttcaggagctcctgatggaggtgtggactatccttgcagactttagcaagacacgccggcttgtagaggatagttcagacgggtgctccgggttctggagacactggtttggaactcctctatctcgcctggtgtacacagttaagaaggattataacgaggaatttgaaaatctttttgccgactgctctggcctgcttgattctctgaattttggccaccagtcccttttccaggaaagggtcctccacagccttgatttttccagcccagggcgcactacagccggggttgcttttgtggtttttctggttgacaaatggagccagaacacccaactgagcaggggctacattctggacttcgcggccatgcacctgtggagggcctgggtcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcagggtgctgacatccatggccaggggagtgaagagggagaggagcgatgggggcaataccgggatgatgacagagctgacggccagcctgatgaatcgcaagcgcccagagcgcattacctggcatgagctacagatggagtgcagggatgaggtgggcctgatgcaggataaatatggcctggagcagataaaaacccactggttgaacccagatgaggattgggaggaggccattaagaaatatgccaagatagccctacgcccagattgcaagtacagggtgaccaagacggtgcatatcagacatgcctgctacatctcagggaacggggcagaggtggtcatcgataccctggacaaggccgccttcaggtgttgcatgatgggaatgagagccggagtgatgaatatgaattccatgatctttatgaacatgaagttcaatggagagaagtttaatggggtgctgttcatggccaacagccacatgaccctgcatggctgcgactttttcggctttaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacatgcgactcgggggtctgccatattctgaagaacatccatgtgacctcccacccccggaagaagtggccagtgtttgagaataacctgcttatcaagtgccacgtgcacctgggtgccagaaggggcaccttccagccgtaccagtgtaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcttcgagctacatgcccagcagcagcagtagcccctctgtgcccagttccatcatcgccgaggagaaactgctggccctgctggccgagctggaagccctgagccgccagctggccgccctgacccagcaggtgtccgatctccgcgagcaacagcagcaaaataaatgattcaataaacacagattctgattcaaaagcaaagcatctttattatttattttttcgcgcgcggtaggccctggtccacctttcccgatcattgagagtgcggtggattttttccaggacccggtagaggtgggattggatgttgaggtacatgggcatgagcccgtcccgggggtgtaggtagcaccactgcatggcctcgtactctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcaatgttgccgcccagatcccgcctggggttcatgttgtgcaggaccaccaggacggtgtagcccgtgcacttggggaacttatcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaataaatttggggcggagggtgccagattgggggacgatggttccctcgggccccggggcaaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggttgggccgtagatgaccccgatgacgggttgcaggtggtagttcaaggagatgcagctgccgtcgtcccggaggaggggggccacctcgttgagcatgtccctgacttggaggttttcccggacgagctcgccaaggaggcggtctccgccgagcgagagtagctcttgcagggaagcaaagtttttcaggggcttgagcccgtcggccatgggcatcttggcgagggtctgcgagagtagctccaggcggtcccagagctcggtgacgtgctctacggcatctcgatccagcagacttcctcgtttcgggggttgggacgactgcgactgtagggcacgagacgatgggcgtccagcgctgccagcgtcatgtccttccatggtctcagggtccgcgtgagcgtggtctccgtcacggtgaaggggtgggccccgggctgggcgcttgcaagggttcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggtgcgagaaagacggactcgggggcgaaggcgtccgctccgcagtgggcgcagacggtctcgcactcgacgagccaggtgagctcggggtgttcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccaccgtgtgcaggcacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcattggagagaagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaaagggggcagcacatcaagcagatgctcgtcaggggggtccgcatcgatggtgaagatgccgggacatagttccttgtcaaaatagtctatttttgaggatgcatcatccaaggccatctgccactcgcgggcggccatcgctcgctcgtaggggttgaggggcggaccccagggcatggggtgcgtgagcgcggaggcatacatgccgcagatgtcatagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgtggcaggcggaccgagtcgcggatgaagtgcgcgtaggagtcttgcagcttggcgacgagctcggcggtgacgaggacgtccatggcgcagtagtccagcgtttcgcggatgatgtcataacccgcttctcctttcttctcccacagctcgcggttgagggcgtactcctcgtcatccttccaatactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgctcgcggcatgaaattgcggctgatgcggaaagggcccgggacggaggctcggttgttgatgacctgggcggcgaggacgatctcgtcgaagccgttgatattgtgcccgacgatgtatagttccatgaatcgcgggcggcctttgatgtgcggcagctttttgagctcctcgtaggtgaggtcctcggggcattgcaggccgtgctgctcgagggcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggtgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttccactggggagttggtggccgtgtccacgcattgcatgagcccgtagctgcgcggggccacgaccgtgccgcggtgcgcttttagaagcggtgtcgcggacgtgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccaccggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcatttgagatgcgacccatgagctgcgagaaggcgcccagcccgctctcgttccagacgcggctgtagactacgtccccgtctgcgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcttcgtagaaatccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagtagccccgtggacgctgttagaattgcggttgctgatgatgtaattgaagtaggcgtttttaaggcggcggatggtggcgaggaggaccaggtccttgggtcccgcttgctggatgcggagccgctcggccatgccccaggcctggccctgacaccggctcaggttcttgtagtagtcatgcatgagcctctcaatgtcatcactggcggaggcggagtcttccatgcgggtgaccccgacgcccctgagcggttgcacaagcgccaggtcggcgacgacgcgctcggcgaggatggcctgttgcacgcgggtgagggtgtcctggaagtcgtccatgtcgacgaagcggtggtaggccccggtgttaatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgaggggggtcgctagacttgaaagcggccgaaaaccccgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcaccggcgctagccagccacagacagagatggacttggaagagggcgaagggctggcgagactgggggcgccgtccccggagcgacacccccgcgtgcagctgcagaaggacatgcgcccggcgtacgtgcctccgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggctgcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaatccggacagcaagcctctgacggcgcagctgttcctggtggtgcagcacagcagggacaacgaggcgttcagggaggcgctgctgaacatcgccgagcccgagggccgctggctgctggagctgattaacatcttgcaaagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacgacttggatgaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccacaggccaacagactttcggccattctggaggcggtggtcccctctcggaccaaccccacgcatgagaaggtgctggcgatcgtgaacgcgctggcggagaacaaggccatccgtcccgacgaggccgggctggtgtacaacgccctgctggagcgcgtgggccgctacaacagcacaaacgtgcagtccaacctggatcggctggtgacggacgtgcgcgaggccgtggcgcagcgcgagcgattcaagaacgagggccttggctcgctggtggcgctgaacgccttcctggcaacgcagccggcgaacgtgccgcgcgggcaggacgattataccaactttatcagcgcgctgcggctgatggtgaccgaggttccccagagcgaggtgtaccagtcgggcccggactactttttccagactagcagacagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggatgagcagaccttccaggagatcacgagcgtgagccgcgcgctggggcagaacgacaccgacagtctgagggccaccctgaacttcttgctgaccaatagacagcagaagatcccggcgcagtacgcactgtcggccgaggaggaaaggatcctgagatatgtgcagcagagcgtagggctgttcctgatgcaggagggcgccacccccagcgccgcgctggacatgaccgcgcgcaacatggaacctagcatgtacgccgccaaccggccgttcatcaataagctgatggactacctgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacttttcaaaagcgccaggaggcgccgccgagcgagggagcggtggggaggagcccctttcctagcttagggagtttgcatagtttgccgggctcggtgaacagcggcagggtgagccggccgcgcttgctgggcgaggacgagtacctgaacgactcgctgctgcagccgccacgggccaagaacgccatggccaataacgggatagaaagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggtggggccaacccgttcgcgcatctgcagcccagactggggcggcggatgttttgaaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtgtctaggaaaaaggcggaaggggctgatgagaatgataggagcaaggatattctagagtatcagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacatacgaggccttccacccggacgtggtgctgctgcctggctgtggggtggacttcaccgagagccgcctgagcaacctcctgggcattcgcaagaagcaacctttccaagagggcttcagaatcatgtatgaggatctagaagggggcaacatccccgctctcctggataccaaaaaatatctggatagcaagaaagacattgaagatgcaaagcagaaagcggcgcaggcaggtggtgagatcagaggagacagtgctgatactagagctgcagagaaggcggctgaaaaagagctggttattgaacccatcgagcaagatgaaagcaagaggagctataatgtgatcaaggggacccatgacaccctgtaccgaagctggtacctgtcctatacctacggggaccccgagaagggggtgcagtcgtggacgctgctcaccaccccggacgtcacctgcggcgcggagcaagtctactggtcgctgccggacctcatgcaagacccggtcaccttccgctccacccagcaagtcagcaactaccccgtggtcggcgccgagctcatgcccttccgcgccaagagcttttacaacgacctcgccgtctactcccagctcatccgcagctatacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaaaaaaatgtctattctcatctcgcccagcaataacaccggctggggtattactaggcccagcaccatgtacggaggagccaagaagcgctcccagcagcaccccgtccgcgtccgcggccacttccgcgctccctggggcgcttacaagcgcgggcggactcccgccgctgccgtgcgcaccaccgttgacgacgtcatcgactcggtggtcgccgacgcgcgcaactatactcccgccccctcgaccgtggacgcggtcattgacagcgtggtggccgacgcgcgcgactatgccagacgcaagagtcggcggcgacggatcgccaggcgccaccggagcacgcccgccatgcgcgccgcccgggctctgctgcgccgcgccagacgcacgggccgccgggccatgatgcgagccgcgcgccgcgctgccactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggatgaaacgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgaaaacatgtacccgaccatgcagatcatggtgcccaagcgccggcgcgtggaggacgtgctggacaccgtgaaaatggatgtggagcccgaggtcaaggtgcgccccatcaagcaggtggtgccgggcctgggcgtgcagaccgtggacattcagatccccaccgacatggatgtcgacaaaaaaccctcgaccagcatcgaggtgcagaccgacccctggctcccagctacttctaccgccaccgcatccacttctaccatggctaccgagcctccaaggaggcgaagatggggcgccgccagccggctgatgcccaactacgtgttgcatccttccatcatcccgacgccgggctaccgcggcacccggtactacgccagccgcaggcgcccagccgccaaacgccgccgccgcaccaccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcgggttcctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcttcctccgcccaaaggcgagaagcggccgcggcccgacgcggaggagacgatcctgcaggtggacgagccgccctcgtacgaggaggccgtcaaggccggcatgcccactacgcgcattatcgcgccgctggccacgggtgtaatgaaacccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgcttttgagagagaggagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacgtactttgacatccgcggcgtcctggaccgcggtcccagcttcaaaccctactcgggcacagcttacaacagcctggcccccaagggcgcccccaatcccagtcagtggactaccaaagaaaagcagaccggagtaaatgcaggagacaaagaagttacaaagacatttggacttgccgccatgggaggcagtaatatttctaaggacggtttgcagattggaactgacacaacaccagatgctgtaaaaccaatatatgcagacaaaacttaccagccagaacctcaagtgggagaagaaaactggcaggataatgatgaatattatggcggcagggctcttaaaaaagatactaaaatgaagccatgctatggttcctttgctaaacccacaaacaaggaaggtggccaggctaaattgaaagaaacacccaatggtgctgatcctcaatatgatgtggacatggccttcttcgattcaaccactataaacattccagatgtagtgttatacactgaaaatgtagatttggaaactccagatacacatgtggtgtacaaaccaggcaaagaggatgaaagttctgaagctaacttaactcagcagtccatgccaaacagaccaaactacattggcttcagagacaactttgtggggctcatgtattacaacagcactggaaacatgggtgtgctggctggtcaggcttcccaattgaatgctgtggtcgacttgcaagacagaaacacagagctgtcttaccagcttttgctagattctctgggtgacagaaccagatactttagcatgtggaactctgcggtggacagttatgatcccgatgtcaggatcattgaaaatcatggtgtggaagatgaacttccaaactattgcttccccttggacggtgttcaaactaattcagcctaccaaggtgttaaactaaaggctaatcaagcaggaggtggagctaatggagactgggaaaaggatgataccatttcagcccataatcaaattggaaagggcaacatctttgccatggagatcaacctccaggccaacctgtggaagagttttctgtactcgaacgtggctctgtacctgcccgactcctacaagtacacgccggccaacgtcacgctgcccaccaacaccaatacctatgagtacatgaacggccgcgtggtggcaccctcgctggtggatgcctacatcaacatcggcgcccgctggtcgctggaccccatggacaatgtcaaccccttcaaccaccaccgcaacgcgggcctgcgctaccgctccatgcttctgggaaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtacccatctccatcccctcgcgcaactgggccgccttccgcggctggagtttcacccgtctcaagaccaaggaaactccctccctcggctcgggtttcgacccctactttgtctactcgggctcgatcccctaccttgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggatacaaggaccgcatgtactccttcttccgcaacttccagcccatgagcaggcaggtggtcgatgagatcaactacaaggactacaaggccgtcaccctgcccttccagcacaacaactcgggcttcgtcggctacctcgcacccaccatgcgccaggggcagccttaccccgccaacttcccctacccgctcatcggccagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgccttcggctggaacccgcgctcgcgcacctgctacatgttcgaccccttcgggttctcggaccgccggctcaaacagatttacagcttcgagtacgaggccatgctgcgccgaagcgccctcgcctcctcgcccgaccgctgtctcagcctcgagcagtccacccagaccgtgcaggggcccgactccgccgcctgcggactcttctgttgcatgttcttgcatgctttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccctactttcgctcccaccgcgccgccatcgaacacgccaccgcttttgataaaatgaaacaactgcgtgtatgactgaaataaacagcacttttattttacacaagcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggctgagatcttgaaatcgcagttgggaccggtgctctgcgcgcgcgagttgcggtacacggggttgcagcactggaacaccatcagactggggtgcttcacgctggccagcacgctcttgtcgctgatctgatccttgtccaggtcctcggcgttgctcaggccgaacggggtcatcttgcacagctggcggcccaggaagggaacgctgtggggcttgtggttacactcgcagtgcacgggcatcagcatcatccccgcgccgcgctgcatattcgggtagagggccttgacgaaggccgtgatctgcttgaaagcttgctgggccttggccccctcgctgaagaacaggccgcagctcttcccgctgaactggttattcccacatccggcatcttgcacgcagcagcgggcgtcatggctggtcagttgcaccacgcttcgaccccagcggttctgggtcaccttggccttgctgggctgttccttcaacgcgcgctgtccgttctcgctggtcacatccatctccaccacgtggtccttgtggatcatcaccgttccgtgcagacacttgagctggccttccacctcggtgcatccgtggtcccacagggcgcagccggtgcactcccagttcttgtgcgcgatcccgctgtggctgaagatgtaaccttgtaacaggcggcccatgacggtgctaaaggttttctgggtggtgaaggtcagttgcagcgcgcgggcctcctcgttcatccaggtctggcacatcttttggaagatctcggtctgctcgggcatgagcttgtaagcatcgcgcaggccgctttcgacgcggtagcgttccatcagcacgttcatggtatccatgcccttctcccaggacgagaccagaggcagactcagggggttgcgcacgttcagaataccgggggtcgcgggctcgacgatgcgttttccgtccttgccttccttcaacagaaccggcggctggctgaatcccactcccacgatcacggcatcttcttcctggggcatctcttcgtcggggtctaccttggtcacatgcttggtcttcctggcttgcttctttggcagttttggagggctgtctacggggaccacgtcctcctcggaagacccggagcccacccgctggtactttcggcgcttggtgggcagaggaggtggcggcgaggggctcctctcctgctccggcggatagcgcgccgacccgtggccccggggcggagtggcctctcggtccatgaaccggcgcacgtcctgactgccgccggccattgttcctaggggaagatggagccgcgtaagcaggagcaggaggaggagaacttaaccacccacgagcaacccaaaatcgagcaggacctgggcttggaagatcgtctagaacccccacaggatgaacaggagcacgagcaagacgcaggccaggaggagaccgacgctgggctcgagcatggctacctaggaggagatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctaccccgtcttcgcggtccccgaggccctcgccacctatcacatctttttcaagaaccaaaagatccccgtctcctgccgcgccaaccgcacccgcgccgacgcgctcctcgctctggggcccggcgcacgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcagcgccccgaggacgccaaacccgtggtcagcgacgagatgctcgcgcgctggctcgggacccgcgacccccaggccctggagcagcggcgcaagctcatgctggccgtggtcctggtcaccctcgagctggaatgcatgcgccgcttcttcagcgaccccgagaccctgcgcaaggtcgaggagaccctgcactacactttcaggcacgggttcgtcaggcaggcctgcaagatctccaacgtggagctgaccaacctggtctcctgtctggggatcctgcacgagaaccgcctggggcagaccgtgctccactccaccctgaagggcgaggcgcgccgggactatgtccgcgactgcatctttctatttctctgccacacctggcaagcggccatgggcgtgtggcagcagtgtctcgaggacgagaacctgaaggagctggacaagcttcttgctagaaacctcaaaaagctgtggacgggcttcgacgagcggaccaccgccgccgacctggccgagatcgttttccccgagcgcctgaggcagacgctgaaaggcgggcttcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggatgtgatcgaggacgtgagcggcgaggggctgctcgagtgccactgccgctgcaacctgtgctccccgcaccgctccctggtctgcaacccccagctcctgagcgaaacccaggtcatcggtaccttcgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgcccgcagcacgcggatctcacggcctgcgtcatcacccagggcgccatcctcgcccaattgcacgccatccaaaaatcccgccaagagtttcttctgaaaaagggtagaggggtctacctggacccccagacgggcgaggtgctcaacccgggtctcccccagcatgccgaggaagaagccgctagtggaggaggagatggaagaagaatgggacagccaggcagaggaggaagaatgggaggaggagagtacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgccggaggaggaggaggcctgaggatcgcggcgaacgagccattgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccaccatgagcaaggagattcccacaccttacatgtggagctatcagccccagatgggcctggccgcgggcgcctcccaggactactccacccgcatgaactggctcagtgccgggccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgtgaccggggcgccaccacctacaccgtctactgcatctgtcctaccccgaagttgcatgagaatttttgctgtactctgtgtgctgagtttaataaaagctaaactcctacaatactctgggatcccgtgtcgtcgcactcgcaacgagaccttcaaccttaccaatcagactgaggtaaaactcaactgcagaccaggggacaaatacatcctctggctctttgagaacacttccttcgcggtctccaacacctgcgccaacgacggtattgaaatacccaacaaccttaccagtggactaacttacaccaccagaaagactaagctagtactctacaatccttttgtagagggaacctaccactgccagagcggaccttgcttccacactttcactttggtgaacgttaccggcagcagcacagccgctccagaaacatctaaccttctttctgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatttgctgggtcatacattgttgggaggaaccatgaaggggctcttgctgattatcctttccctggttgggggtgtactgtcatgccacgaacagccacgatgtaacatcaccacaggcaatgagaggagtgtgatatgcacagtagtcatcaaatgcgagcatacatgtcctctcaacatcacattcaagaataagaccatgggaaatgcatgggtgggcgattgggaaccaggagatgagcagaactacacggtcactgtccatggtagcaatggaaatcacactttcggtttcaaattcatttttgaagtcatgtgtgatatcacactgcatgtggctagacttcatggcttgtggccccctaccaaggagaacatggttgggttttctttggcttttgtgatcatggcctgtgcaatgtcaggtctgctggtaggggctataatatggttcctgaggcacaagcccaggtatggaaatctggaaaaggaaaaattgctataaatgtttttctttccacagcatcatgaatacagtgatccgtatcgtgctgctctctcttcttgtagcttttagtcaggcaggatttcatactatcaatgctacatggtgggctaatataactttagtgggaccctcagatacgccagtcacctggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaataaaacattagttggacctccaggaataccagttacttggtatgacggagaaggaaataaattctgcgatggaaaaaaagttgaacatgcagaatttaatcatacatgtgacgtgcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaactgggcaaaaacaaaatgagcataaacagggtgggcagaaacaggaggggcaaaaagagacaagtcaaaagaaagctaatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgtgaacctggatataagttaaactgtaagtgtgacaatcaaaacctaaccctaatcaatgtaactaaactttatgagggagtttactatggtactaatgacggaggcaacggcaaaagatacagagtaaaagtaaacactacgaattctcaaaatgtgaaaattcagccgtacaccaggcctactactcctgatcagaaacacagatttgaattgcaaattgattataatcaagacaatgacaaaattccatcaactactgtggcaatcgtggtgggtgtgattgcgggcttcataactctgatcattgtcattctgtgctacatctgctgccgcaagcgtccaagggcatacaatcatatggtagacccactactcagcttctcttactgagactcagtcactttcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttacagcctataaatgcttcagtaatggaagcattacaattactgccactgctaatattacttctggcacaatcaaggcagaaagctataaaaatgaaatgaaaaaaatggtatataaaaataacaagacaacatttgaagattctggaaattatgagtatcagaaattatctttttataatctgacaattattgagctgccaactactaaggctcccacagttaggacaacgcagcctaccactgtacccactacacatccaaccaccacagccagtacaactactgagaccacaactcacactacagtgcagaatagtactgtattggttaggtatttgttaagagaggaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtttgtgggatctttattcttgtggttcttctgtactttgtctgctgcaaagccagagaaaaatctaggagacccatctacaggccagtaatcggggatcctcagcctctccaagtggaagggggtctaaggaatcttctcttctctttttcagtatggtgattcagccatgattcctaggttcttcctatttaacatccttttctgtctattcaacgtgtgcgctgccttcgcggccgtctcgcacgcctcgcccgactgtctcgggcccttccccacctacctcctctttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatttgaccatgcagactctgctcatactgctatccctcctctcccctgccctcgctgatgatgattactctaagtgcaaatttgtggagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcctccacgccaccacccacacctcctccccgcagaaatcagtttcccctgattcagtacttagaagagccccctccccgacccccttccactgttagctactttcacataaccggcggcgatgactgaccacctggacctcgagatggacggccaggcctccgagcagcgcatcctgcaactgcgcgtccgtcagcagcaggagcgggccgccaaggagctccttgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcatcaaccccatagtcatcacccagcagtcgggcgaggccagcggttgcatccactgctcctgcgaaagccccgagtgcatctactccctcctcaagaccctttgcggactccgcgaccttctccccatgaactgatgttgattaaaatcccagaaaccaatcagccccttaccccattcccctcccacaattactcataagaataaatcattggaattaatgattcaataaagatcacttacttgaaatctgaaagtatgtctctggtgtagttgttcagcagcacctcggtaccctcctcccagctctggtactccagtcctcggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttccttactcccccctttgtctcatccgatggattcaaaaacttcccacctggggtcctgtcactcaaactggctgacccaatcgccatcactaatggggatgtctcactcaaggtgggagggggactaactgtggaacaagatagtggaaacctaagtgtaaaccctaaggctccattgcaagttggaacagacaaaaaactggaattggctttagcacctccatttgatgtcagagataacaagctagctattctagtaggagatggattaaaggtaatagatagatcaatatctgatttgccaggtttgttaaactatcttgtagttttgactggcaaaggaattggaaatgaagaattaaaaaatgacgatggtagcaataaaggagtcggtttatgtgtgagaattggagaaggaggtggtttaacttttgatgataaaggttatttagtagcatggaacaataaacatgacatccgcacactttggacaactttagacccttctccaaattgtaagatagatatagaaaaagactcaaaactaactttggtactgacaaagtgcggaagtcagattttggcaaatgtatctctaattatagtcaacggaaagttcaagatccttaataacaaaacagacccatccctacctaaatcatttaacatcaaactactgtttgatcaaaatggagttctattggaaaattcaaacattgaaaaacagtacctaaactttagaagtggagactctattcttccagagccatataaaaatgcaattggatttatgcctaatttactagcttatgctaaagctacaactgatcagtctaaaatttatgcaaggaacactatatatggaaatatctacttagataatcagccatataatccagttgtaattaaaattacttttaataatgaagcagatagtgcttattctatcacttttaactattcatggaccaaggactatgacaatatcccttttgattctacttcatttaccttctcctatatcgcccaagaatgaaagaccaataaacatgttctcatttgaaaattttcatgtatctttattgatttttacaccagcacgggtagtcagtctcccaccaccagcccatttcacagtgtaaacaattctctcagcacgggtggccttaaataggggaatgttctgattagcacgagaactggatttagtgtctataagccacacagtttcctggcgagccaaacgggggtcggtgattgagatgaagccgtcctctgaaaagtcatccaagcgggcctcgcagtccaaggtcacagtctggtggaacgagaagaacgcacagattcatactcggaaaacaggatgggtctgtgcctttccatcagcgccctcaacagtctctgccgccggggctcggtgcggctgctgcagatgggatcgggatcacaagtctctctgactatgatccccacagccttcagcatcagtctcctggtgcgtcgggcacagcaccgcatcctgatctctgccatgttctcacagtaagtgcagcacataatcaccatgttattcagcagcccataattcagggtgctccagccaaagctcatgttggggatgatggaacccacgtgaccatcgtaccagatgcggcaatatatcaggtgcctgcccctcatgaacacactgcccatatacatgatctc

SEQ ID NO: 1442 - DNA, 32767 bp, Human adenovirus 62
catcatcaataatataccccacaaagtaaacaaaagttaatatgcaaatgagcttttgaatttggggcggggccgccgctgattggctgttgggagagccgttactgacgtcacgacgcacggcgtcaacggtcggcgcggaggcgtggcctagcccggaagcaagtcgcagccctgatgacgtataaaaaagcggactttagacccggaaatggccgattttcccgcggctacgcccggatatgaggtaattctgggcggatgcaagtgaaattaggtcattttggcgcgaaaactgaatgaggaagtgaaaagtgaaaaataccgggcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtctgagaaaaatgagacacctgcgccttctaccttcaactgtgcccggcgacctggctgtgataatgctggaggactttgtgaatacagttctggaggacgaactgcatccaagtccgttcgagctgggacccacacttcaggacctctatgatctggaggtagatgcccatgatgacgaccctaacgaagaggctgtgaatttaatatttccagaatctatgattctccaggctgacatagccagcgaagctatagttactccacttcataccccgactctgccaccaatacctgaattggaagaggaggacgagctagaccttcggtgttatgaggaaggttttcctcccagcgattcagaggacgaacagggtgagcagagcatggctctaatctcagactatgcttgtgtggttgtggaagagcattttgtgttggacaatcctgaggtgcccgggcaaggctgtagatcctgccaatatcaccgggataagactggagatcctagtgcctcctgcgctctgtgttacatgaaaaagaacttcagctttatttacagtaagtggagtgaatgtgagagaggctgagtgcttaacacataactgtaatgcttgaacagctgtgctaagtgtggtttatttttgttactaggtccggtgtcagaggatgagtcatcaccctcagaagaagaccacccgtctccccctgagctgtcaggcgaaacgcccctgcaagtgttcagacccaccccagtcagagccagtggagagaggcgagcagctgttgaaaaaattgaggacttgttacatgacatgggtggggatgaacctttggacctgagcttgaaacgccccaggaactaggcgcagatgcgcttagtcatctgtaaataaagttgtacaataaaagtatatgtgacgcatgcaaggtgtggtttatgactcatgggcggggcttagtcctatataagtggcaacacctgggcacttaggcacagaccttcagggagctcctgatggaggtgtggactatccttgcggactttaacaagacacgccggcttgtagaggatagttcagacgggtgctccggtttctggaggcactggtttggatctcctctatctcgcctggtgtacactgttaagaaggattatcaggaggaatttgaaaatctttttgccgattgctctggcctgcttgattcactgaatctcggccaccaggctcttttccaggaaagggtactccacagccttgatttttccagcccaggccgcactacagccggtgttgcatttgtggtgtttctggttgacaaatggagccagcaaacccacctaaccagggattacatcctggacttcacggccatgcacctgtggaaggcctgggtcaggcagcggggacagagaatcttgaactactggcttctacagccagcagctccgggtcttcttcgtctacacagacaaacatccatgttggaggaagagatgagggaggccatggacgagaacccgaggagcggcctggaccctccgtcggaagaggagctggattgaatcaggtatccagcctgtatccagagcttagcaaggtgctgacaaccatggccaggggagtgaagagggagaggagcgatgggggcaataccgggatgatgaccgagctgacagccagcctgatgaatcgcaggcgacctgagcgcattacctggcacgagctacagcaggagtgcagggatgagataggcctgatgcaggataaatatggcctggagcagataaaaacccactggttgaacccagatgaggattgggaggaggccattaagaaatatgccaagatagccctgcgcccagattgcaagtacagggtgaccaagacggtgaatatcagacatgcctgctacatctcagggaacggggcagaggtgatcattgataccctggataaggctgccttcaggtgttgcatgatgggaatgagagccggtgtgatgaatatgaattccatgatcttcatgaacatcaagttcaatggagagaagtttaatggggtgctgttcatggccaacagccatatgaccctgcatggctgtaatttctttggctttaacaacatgtgtgcagaagtctggggtgcttccaagatcaggggatgtaagttttttggctgctggatgggagtggtcggaaggcccaagagcgagatgtctgtgaagcagtgtgtgtttgagaagtgctacctggccgtgtctaccgagggcaatgctagagtgagacattgctcttccatggagacgggttgcttctgcctggtgaagggtacagcctcgatcaagcataatgtgatcaaggggtgtactgatgagcgcatgtataacatgctgacctgcgactcgggggtctgccatatcctgaagaacatccatgtgacctcccaccccaggaagaggtggccatcatttgaaaataatgtcctgatcaagtgccacgtgcacctgggagccagaaggggcaccttccagccgtaccagtgcaactttagccagaccaagctgctgctggagaacgatgccttctccagggtgaacctgaacggcatctttgacatggatgtctcggtgtacaagatcctgagatacgatgagaccaggtccagggtgcgcgcttgcgagtgcgggggcaggcacaccaggatgcagcctgtggccctggatgtgacagaggagctgagaccagaccacctggtgatggcctgtaccggaaccgagttcagctccagcggggaggacacagattagaggtaggttgagtgagtagtgggcgtggctaaggtgactataaaggtgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggacgagctcgtcgctcgacagcaccgccgcagccgcggcagcagcagccgccatgacagcgacgagactggcctcgagctacatgcccagcagcggtagcagcccctccgtccccagttccatcatcgccgaggagaaactgctggccctgctggctgagctggaagccctgagccgccagctggccgccctgacccagcaggtgtccgatctccgcgagcaacagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccggggatggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcgatgttgccgcccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgttcctgggatcagagacatcataattatgctcctgggtgagatcatcataagacattttaatgaatttggggcggagggtgccagactgggggacgatggttccctcgggccccggggcgaagttcccctcgcagatctgcatctcccaggctttcatctcggagggggggatcatgtccacctgcggggcgatgaaaaagacggtttccggggcgggggtgatgagctgcgaggagagcaggtttctcaacagctgggacttgccgcacccggtcgggccgtagatgaccccgatgacgggttgcaggtggtagttcaaggagatgcagctgccgtcgtcccggaggaggggggccacctcgttaagcatgtccctgacttggaggttttcccggacgagctcgccgagaaggcggtccccgcccagcgagaggagctcttgcagggaagcaaagtttttcaggggcttgagcccgtcggccatgggcatcttggcgagggtctgcgagaggagttccaaccggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgatccgcagtgggcgcagacagtctcgcactcgacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccactttttccaccgtgtgcaagcacatgtccccctcctccgcatccaagaaggtgattggcttgtaggtgtaggtcacgtgaccgggggtccccgacgggggggtataaaagggggcgggtctgtgctcgtcctcactctcttccgcgtcgctgtccacgagcgccagctgttggggtaagtattccctctcgagagcgggcatgacctcggcactcaggttgtcagtttctagaaacgaggaggatttgatgttagcctgccccgccgcgatgcttttgaggagactttcatccatctggtcagaaaagactatttttttattgtcaagcttggtggcgaaggagccatagagggcgttggagaggagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcaaggtgaccaggtccacgctggtggccacctcgccgcgcaggggctcattcgtccagcagaggcgcccgcccttgcgcgagcagaaagggggcaacacatcaagcaggtgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgcgtgagcgcggaggcgtacatgccgcagatgtcatagacatagatgggctccgagaggatgccgatgtaggtgggataacagcgccccccgcggatgctggcgcgcacgtagtcatacaactcgtgcgagggtgccaagaaggcggggccgagattggtgcgctggggctgctcggcgcggaagacgatctggcgaaagatggcatgcgagttggaggagatggtgggccgttggaagatgttaaagtgggcgtggggcaagcggaccgagtcgcggatgaagtgcgcgtaggagtcttgcagcttggcgacgagctcggcggtgacgaggacatccatggcgcagtagtcgagcgtttcgcggatgatgtcataacccggctctcctttcttctcccacagctcgcggttgagggcgtactcctcgtcatccttccagtactcccggagcgggaatcctcgatcgtccgcacggtaagagcccagcatgtagaattggttcacggccttgtagggacaacagcccttctccaccgggagggcgtaagcttgagcggccttgcggagcgaggtgtgcgtcagggcgaaggtgtccctgaccatgactttcaagaactggtacttgaagtccgagtcgtcgcagccgccgtactcccagagctcgaaatcggtgcgcttcttcgagagggggttaggcagagcgaaagtgacgtcattgaagagaatcttgcctgctcgcggcatgaaattgcgggtgatgcggaaggggccaggcacggaggctcggttgttgatgacctgggcggcgaggacgatctcgtcgaagccattgatgttgtgcccgacgatgtagagttccatgaaccgcgggcggcctttgatgtgcggcagctttttgagctcctcgtaggtgaggtcctcggggcattgcagaccgtgctgctcgagcgcccactcctggagatgtgggttggcttgcatgaaggaagcccagagctcgcgggccatgtgggtctggagctcgtcgcgaaagaggcggaactgctggcccacggccatcttttcgggggtgacgcagtagaatgtgagagggtcccgctcccagcgatcccagcgtaagcgcacggcgagatcgcgagcgagggcgaccagctcggggtcccctgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatccctccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatatcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtagccgtgtccacgcattgcatgagcccgtagctgcgcggggccacgaccgtgccgcgctttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaagacggcgtagttgcgcaggcgttggaagaggtagttgagggtggtggcgatgtgctcggtgacgaagaagtacatgatccagcggcgcaggggcatctcgctgatgtcgccgatggcctccagcctttccatggcttcgtagaaatccacggcgaagttgaaaaactgggcgttgcgggccgagaccgtgagctcgtcttccaggagcctgatgagctcggcgatggtggcgcgcacctcgcgctcgaaatccccaggggcctcctcctcttcctcttcttcttccatgacgacctcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttctcgaggacgcagcgtgaagacgccgccggtcatctcccggtaatggggcgggtccccgttgggcagcgagagggcgctgactatgcatcttatcaattgcggtgtaggggacgtgagcgcgtcgagatcgaccggatcggagaatctttcgaggaaagcgtctagccaatcgcagtcgcaaggtaagctcagacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtagcccacgaggaagtgcggcggcggctggcggtagaggggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtccctgctcgaatcaggctggagccgcgactaacgtggtattggcactcccgtctcgacccgagcccgatagccgccaggatacggcggagagccctttttgcaggccgcgcggggtcgctagacttgaaagcggccgaaaatcccgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcgagactgggggcgccgtccccggagcgacacccccgcgtgcagctgcagaaggacgtgcgcccggcgtacgtgcccgcgcagaacctgttcagggaccgcagcggggaggagcccgaggagatgcgcgactgccggtttcgggcgggcagggaactgcgcgagggtctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccaccggcggtgaggagtcctacttcgacatgggggcggacctgcattggcagccgagccggcgcgccttggaggccgcctacggtccagaggacttggatgaggatgaggaagaggaggaggatgcacccgttgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcctgcagacggtgaacctgagccaggctttcaagaatctgcgcgggctgtggggcgtgcaggcgcccgtgggcgatcggtcgacggtgagcagcttgctgacgcccaactcgcggctgctgctgctgctgatcgcgcccttcaccgacagcggcagcgtgaaccgcaactcgtacctgggccacctgctgacgctctatagggaggccataggccaggcgcaggtggacgagcagaccttccaggagatcacgagcgtgagccgcgcgctggggcagaacgacaccgacagtctgagggccaccctgaactttttgctgaccaatagacagcagaagatcccgccgcagtatgcgctgtcggccgaggaggaaagaatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggccatgaactcggactactttactaatgctatactaaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggagaagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaaaaggcggaaggggctgatgcagatgatagaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatataggagtcaagtttgacagcaggaatttcaagctgggctgggatccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaagggggcaacatccccgccctcctggatgtcaagcaatatttggatagcaaaaagaagcttgaggaagctacccagaatgcaaccagggccgctggagatatcagaggagacacctatgttccaagagctgtggaacaagcagctgaaaaggatctggtcattgtaccagtaacacaagatgaaagcaagagaagctataatgtcatagatggcacccatgacaccctgtaccgaagttggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctctccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgcagccgccgtgcgcaccaccgtcgacgacgtcatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgccgccgccgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggatgaaacgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgcctagccgcggggtcaagcgcgagggcgagagcatgtacccgaccatgcagatcatggtgcccaagcgtcggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcaacaaaaaaccctcgaccagcatcgaggtgcagaccgacccctggctcccagctacttctaccgccaccgcctctacatccaccatggctaccgagcctcccaggaggcgaagatggggcgccgccagccggctgatgcccaactacgtgttgcatccttccatcatcccgacgccgggctaccgcggcacccggtactacgccagccgcaggcgcccagccgccaaacgccgccgccgcaccaccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcgggtttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcgcccgcccacggtggtggagatggaagatgcaagccatcctccgcccaggggcgagaagcggccgcggcccgacgcggaggagactaccctgcaggtggacgagccgccctcgtacgaggaggccgtcaaggccggcatgtccaccacgcgcatcatcgcgccactggccacgggtgtgatgaaacccgccaccctagacctgcctccaccacccgcgcccgctccaccgaaggcagctcccgcggtcgtgcagcctcctccggtggcgaccgccgtgcgccgcgtccccgcccgccgccaggcccagaactggcagagcacgctgcacagtatcgtgggcctgggagtgaaaagtctgaagcgccgccgatgcttttaagagagaaaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagcctggcccccaagggcgcccccaactccagtcagtgggatgctgaagagaaaaaagatacgcagggaaatgagatggtcaccaagacacatacatatggcgtggcaccaatggcaggaacaaatataacaaagaaaggattgttgcttggaacagatgaaactgccgaggctggtaaaaaagatatctatgcagatgaaacatatcagccagaaccacaggtaggagaagaaaactggcaagaaaatgaagccttctatggaggcagggctctcaaaaaagaaacaaaaatgaagccctgctatggctcatttgccagacctaccaatgaaaaaggcggacaagctaaatttaagccagtggaagaggggcagcaacctaaagaccttgacattacattggctttctttgacacacctggtggaacattgaatggaagtggaactgaagaatataaggcagacattgtgatgtacactgaaaatgtaaatctggaaactccagatacccatgtggtgtacaaaccaggaacttcagatgacagttcagaaatcaatctagttcagcagtccatgcccaacagaccaaactacattggattcagagacaactttgtggggctcatgtattacaacagcactggcaatatgggcgtgctggccggtcaggcctctcagttgaatgctgtggtggacttgcaagacagaaacactgagctgtcttaccagctcttgctagattctctgggtgacagaaccagatactttagcatgtggaactctgcggtggacagctatgatcccgatgtcaggatcattgagaatcacggtgtggaagatgaacttccaaactattgtttcccattggatggctctggaactaattctacataccagggtgtgaaagttacaactaatgaaggagctttggaaagcgaatggggtaaagatgaaagtgttgcgagacaaaatcaaatttgcaagggcaacatctatgccatggagatcaacctccaggccaacctgtggaagagttttctgtactcgaacgtggccttgtacctgcccgactcctacaagtacacgccggccaacgtcaagctgcccgccaacaccaacacctacgagtacatgaacggccgcgtggtggccccctccctggtggacgcctacatcaacatcggcgcccgctggtcgctggaccccatggacaatgtcaaccccttcaaccaccaccgcaacgcgggcctgcgctaccgctccatgctcctgggcaacggccgctacgtgcccttccacatccaagtgccccaaaagttctttgccatcaagaacctgcttctgctcccgggctcctacacctacgagtggaacttccgcaaggacgtcaacatgatcctgcagagttcccttggcaacgacctgcgcgtcgacggcgcctccgtccgcttcgacagcgtcaacctctacgccaccttcttccccatggcgcacaataccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggctgccttccgcggctggagtttcacccggctcaagaccaaggaaactccctccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgttcagatgctctcccactacaacatcggctaccagggcttccacgtgcccgagggatacaaggaccgcatgtactccttcttccgcaacttccagcccatgagcaggcaggtggttgatgagatcaactacaaggactacaaggccgtcaccctgcccttccagcacaacaactcgggcttcgtcggctacctcgcacccaccatgcgccaggggcagccctaccccgccaacttcccctacccgctcatcggctccaccgcagtgccctccgtcacccagaaaaagttcctctgcgacagggtcatgtggcgcatccccttctccagcaacttcatgtccatgggcgccctcaccgacctgggtcagaacatgctctatgccaactcggcccacgcgctcgacatgactttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacataagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgccttcggctggaacccgcgctcgcgcacctgctacatgttcgaccccttcgggttctcggaccgccggctcaagcagatttacagcttcgagtacgaggccatgctgcgccgaagcgccctggcctcctcgcccgatcgctgtctcagcctcgagcagtccacccagaccgtgcaggggcccgactctgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactcaccctactttcgctcccaccgcgccgccatcgaacacgccaccgcttttgataaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggagtctcggggaaggtctcgctccacatgcgccggctcatctgcagggcgcccagcatgtccggggctgagatcttgaaatcacagttgggaccggtgctctgcgcacgcgagttgcggtacacggggttgcagcactggaacaccatcagactgggatgcttgacgctggccagcacgctcttgtcgctgatctgatccttgtccaggtcctctgcgttgctcaggccgaacggggtcatcttgcacagctggcggcccaggaagggcacgctgtggggcttgtggttacactcgcagtgcacgggcatcagcatcattcccgcgccgcgctgcatattcgggtagagggccttgacgaaggccgtgatctgcttgaaagcttgctgggccttggccccctcgctgaagaacagaccgcagctcttcccgctgaactggttattcccgcagccggcatcctgcacgcagcagcgcgcgtcatggctggtcagttgcaccacgcttctcccccagcggttctgggtcaccttggccttgctgggctgttccttcaacgcgcgctgaccgttctcgctggtcacatccatctccaccacgtggtccttgtggatcatcaccgtcccgtgcagacacttgagctggccttccacctcggtgcagccgtggtcccacagggcgctgccggtgcattcccagttcttgtgcgcgatcccgctgtggctgaagatgtaaccttgcaacaggcggcccatcacggtactaaagctcttctgggtggtgaaggtcagttgcagggcgcgggcctcctcgttcagccaggtctggcacatcttctggaagatctcggtctgctcgggcatgagcttgtaagcatcgcgcaggccgctttcgacgcggtagcgttccatcagcacgttcatggcatccatgcccttctcccaggacgagaccagaggcagactcagggggttgcgcacgttcagaataccgggggtcgcgggctcgacaatgcgttttccgtccttgccttccttcaacagaaccggcggctggctgaatcccactcccacgatcacggcatcttcttcctggggcatctcttcgtcggggtctaccttggtcacatgcttggtcttcctggcttgcttctttggcagttttggaggggtgtctacggggaccacgtcctcttcggaagacccggagcccacccgctggtactttcggcgcttggtgggcagaggaggtggcggcgaggggctcctctcctgctccggcggatagcgcgccgacccgtggccccggggcggagtggcctctcggtccatgaaccggcgcacgtcctgactgccgccggccattgtttcctaggggaagatggagcagccgcgtaagcaggagcaggaggaggagaacttaaccacccacgagcaacccaaaatcgagcaggacctgggcttggaagatcgtctagaacccccacaggatgaacaggagcacgagcaagacgcaggccaggaggagaccgacgctgggctcgagcatggctacctgggaggaggagatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctaccccgtcttcgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccatttcgcctaccccgccgtcaacctcccgcccaaggtcatgcgtcgcatcatggatcagctcatcatgccccacatcgaggctctcgatgaaagtcaggagcagcgccccgaggacgcccggcccgtggtcagcgacgagatgctcgcgcgctggctcgggacccgcgacccccaggccctggagcagcggcgcaagctcatgctggccgtggtgttggtaaccctcgagctggaatgcatgcgccgcttcttcagcgaccccgagaccctgcgcaaggtcgaggagaccctgcactacactttcaggcacgggttcgtcaggcaggcctgcaagatctccaacgtggagctgaccaacctggtctcctgcctggggatcctgcacgagaaccgcctggggcagaccgtgctccactcgaccctgaagggcgaggcgcggcgggactatgtccgcgactgcgtctttctctttctctgccacacctggcaagcggccatgggcgtgtggcagcagtgtctcgaggacgagaacctgaaggagctggacaagcttcttgctagaaacctcaaaaagctgtggacgggcttcgacgagcggaccaccgccgccgacctggccgagatcgttttccccgagcgcctgaggcagacgctgaaaggcggtctgcccgacttcatgagccagagcatgatacaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctcctgagcgaaacccaggtcatcggtaccttcgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgcccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctccctcagaatgccgaggaagaagccgctagtggaggaggaggtgatggaagaagaatgggacagccaggcagaggaggacgactgggaggaggaggagagtacagaggaggaagaattggaagaggtggaagaggagcaggcaacagagcagcccgtcgccgcaccatccgcgccggcagccccggcggtcacggatacaacctccgctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggaggaggcctgaggatcgcggcgaacgagccctcgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccaccatgagcaaagagattcccacaccttacatgtggagctatcagccccagatgggcctggccgcgggcgcctcccaggactactccacccgcatgaactggctcagtgccgggccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggctcgccaggcctctacccggacgagttcatcccgaacttcgacgcggtcagcgaatcggtggacggctacgactgaatgtcctatggtgactcggctgagctcgctcggttgaggcatctggaccactgccgccgcctgcgctgcttcgcccgggagagctgcggcctcatctactttgagctgcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccccagccgaagttgcatgagaatttttgttgtactctttgtgctgagtttaataaaagctgaaataagaatcttctctggaccttgtcatcgacctcggaacaccaccgttttactcaccaatcagaccaaggttcgtctgaactgtacaaccagcaggaagtaccttctctggacttttcaaaacacctcactcgctgttgtcaacgcccgtgacgacgacggtgttttaatccccaataacctcaccagtggacttactttcagcaccagaaaaactaagctcgtcctccacaaaccttttgtagagggaacctaccagtgccgacacggaccttgtgttcacaacttccatttggtgaaccttaccagcagcagtacagttgctcctgaaacaactaacctttcttctgatactaacaaacctcgtgtcggaggtgagctttgggttccctctctaacagagggtgggagtcatattgaagtggtcgggtatttgattttaggggtggtcctgggtgggtgcatagcggtgctatatcaccttccttgctgggtcgaaatcagagtctttatctgctgggtcagacattgtggggaggaaccatgaaggggctcttgctgattatcctttccctggtggggggtttactggcctgccacgaacagccacgatgtaacatcaccacaggcaatgagaggaacgactgctctgtagtgatcaaatgcgagcaccagtgtcctctcaacattacattcaaaaataagaccatgggaaatgtatgggtgggattctggcaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggagaacatggttgggttttctttggcttttgtgatcatggcctgcttgatgtcaggtctgctggtaggggctctagtgtggttcctaaagcgcaagcccaggtacggaaatgaggagaaggaaaaattgctataaatctttttctcttcgcagaaccatgaatactttgaccagtgtcgtgctgctctctcttcttgtggtttttagtcagggaaaaatagatagtgaagatattattggtcattggggtaaaaatataacactagttggaccgacagaaaaacctattgaatggcatggaccaagagttcagctttgcgatggtccaaaaattttacatacagaatttaatcacacctgtaatgaacagaatctcactctgatattcttgaacaacacttttaatgggaagtactatggtattagaaaggatgggtttggaatgaaacagtacaatcttaaggttattgcaccaaaagcttctactcgcaaacctctttccccacctcagcaaattaatgtcagaatgggacaaaatgtaactctagttgggccagtagatactccagttaattggcatggaccaaaacatgaactgtgtagaggaaatcaaaaaatacatccagaagttaatcatacatgcaatgaacagaacctcacattgctgtttgttaactacactttctggggagcatactttggatttaacagatatggtactgacagagtgcattatgaggttacaataatagatggcttcgaaaatgcggggcagcaaaaagatgatgagccaagtcagcacaagcctagcagtaaagataggccaaatccaaaagtaaaaaatcctcagaaacaaaacacacacaagacaaacatgcagaacaaaaaggatattgataaagattttccaagaggatctaatcaaactcttgtgggacctcctggttcaaaagttgactggtatgaaggaaaaaatggtgaccttgtaaaactctgcgatggaaagtctggtttaaaggtttcatgcaatgatcaaaacatcactttgattgatgtgaatgaaacctatgctggaacttattatggctctaacaatgacgaccatagacagtatagagttactgtctatacaataccgcgtaataaaactgttaaaattcaacctcataccacaaaaggaaccacagggggtaccacagttaatgaacagtttgctctgcatcaaggtaatgatgaaaccaatcaagatgatgaacaaattccatcaactactgtggcaatcgtggtgggagtgattgcgggcttcataactctgatcattgtcattctgtgctacatctgctgccgcaagcgtcccagggcttacaatcatatggtagacccactactcagcttctcttactgagactcagtcactctcatttcagaaccatgaaggctttcacagcttttgttctgattagcctagtcacacttagttcaactgctgcggctgcttgttatcataagcttaatcttactagaggagaaaacattacactaacaggtgcaggaattaataatacatggtcagtatatcaccatgatggatcaaagaatggatatcaagaagtatgtccatggaatgacggtcgctatgtctgtaatggagatagcagtactattactaatcttacagttgtagctaatgcaaatttaacaagcagaaaatttaaatcatatagttataacaataatgatggatatgaaactgttaagttatgtatttatgagattacaatcattgaaattccaacaaccaaagctccaaccacagttaggacaactagggaaacaaccacacagttaactactagagaaacaacgcagcctaccactgtgcccaccacacatactgaaaccactactcaaactacacagctatacacaacagtgcagaatagtactgtgattgttaggtatctgttgagggaggaaagtactactgaacagacagaggctacctcaagtgccttcagcagcactgcaaatttaacttcgcttgcttcggttaatgaaaccgtcatcgcattgaaactggatcaagatcgaggtttggatatgcaaattacttttctaattgtctgtgggatctttattcttgcggttcttctctactatgtcttttgcaaggccagatcaaagtctcatagaacaatctacaggccagtaatcggggatcctcagccactccaagtggaaggaggtctaaggaatcttctcttctctttttcagtatggtgatcagccatgattcctaggttcttcctatttaacatcctcttctgtctcttcaacgtgtgcgctgccttcgcggccgtctcgcacgcctcgcccgactgtctcgggcccttccccacctacctcctctttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatctgaccatgcagactctgctcatactgctatccctattctcccataccctcgctgatgattactctaagtgcaaatttgtagagctatggaatttcttagactgctatgatgctaaaatggacatgccttcctattacttggtgattgtggggatagtcatggtttgctcctgcactttctttgccattatgatctacccctgttttgatctcggctggaactctgttgaggcattcacatacacactagaaagcagttcactagcctccacgccaccacccacaccgcctccccgcagaaatcagttccccctgattcagtacttagaagagccccctccccgacccccttccactgttagctactttcacataaccggcggcgatgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcctgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctcctcaagaccctttgcggacttcgcgacctcctcccaatgaactgattgattaaagcccataaaccaatcaatccccttccccatcacctcaataaacaatcattggaaataaacattcaataaagatcacttacttgaaatctgaaagtatgtctctggtgtagttgttcagcagcacctcggtcccctcctcccagctttggtactccagtccccggcgggcggcaaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatagccattgacaatgggaatgtctcactcaaggtgggaggggggctcactgtggaacaagatagtggaaagttaattgtgaatcctaaggctcccttgcaagttgcaaatgggcaattggaattagcatatgatgctccatttgatgttaaaaacaacatgcttactattaaagcaggccatggcttagcagtggtaacaaaagacaatactagtttacaaccactactgggtacccttgttgtgttaactggcaaaggcattggcactggcacaagtgctcacggtggaaccatagatgtgagaatagggaaaaacggaagtcttgcatttgacaaagatggagatttggtggcctgggacaacgaaaacgacaggcgcactctatggacaactccagacacatctccaaattgcaaaatgagtaaagaaaaagattcaaagcttactcttaccctaacaaaatgtggaagccaaattctaggaagtgtatctttattagcggtcagtggggaatatctaaatatgaccacaaacactaatagaacaataacaattaaattgttgttcgatgctaagggtgtcttattgacttcttcttcaattagtggtgattactggaacttcagaaataataactccactgtgtcgaataaatatgaaaatgcagtggcgtttatgcctaatttaactgcatatcctaaaccaactacaacgaaaagttatgctaggagctacatttatggaaacgtttatttgggagcactatcttaccaaccagttattataaagataagttttaatcaggaaaaagatgtaaactgtgcatactctattacatttgagtatacttgcactaaggattatgctaatcagcaatttgatgtgagttcctttaccttctcctatattgcccaagaatgaaagaccaataaacgtgttttcatttgaaaattttcatgtatctttattgatttttacaccagcacgggtagtcagtctcccaccaccagcccatttcacagtgtaaacaattctctcagcacgggtggccttaaatagggcaatgttctgattagtgcgggaactggacttggggtctataatccacacagtttcctggcgagccaaacgggggtcggtgattgagatgaatccgtcctctgaaaagtcatccaagcgggcctcacagtccaaggtcacagtctggtggaatgagaagaacgcacagattcatactcggaaaacaggatgggtctgtgcctctccatcagcgccctcaacagtctctgccgccggggctcggtgcggctgctgcagatgggatcgggatcgcaagtctctctgactatgatccccacagccttcagcatcagtctcctggtgcgtcgggcacagcaccgcatcctgatctctgccatgttctcacagtaagtgcagcacattatcaccatgttattcagcagcccataattcagggcgctccagccaaagctcatgttggggatgatggaacccacgtgaccatcgtaccagatgcggcagtatatcaggtgcctgcccctcatgaacacactgcccatatacatgatctctttgggcatgtttctattcacaatctgacggtaccagggga

SEQ ID NO: 1443 - DNA, 32767 bp, Human adenovirus 61
catcatcaataatataccttacactggatttgagccaatattaaaatgaagtgggcggagtgaatagttaattgaccgtaggcgtggtttgcaagtttgccgaagccggatgtgacgcgtgtgggagccgggcgcgccggatgtgacgcgttagtcgccatttttatcggaaatgacatgttttttgggcgttgttgtgtaagttttgtgtttttggcggtaaaagtgatttgcggaagtgaaaactgtttacgtcagttttattataggcgagtaatatttaccgagggcaaagtgaactttgagccactacgtggtggtttcgatacgtgagcgatagggaaactccacgttggtgtccaaaggacacgtttattgttctgtcagctgggtatttaatcccgctgcgtttgtcaagaggccactcttgagtgccagcgagaagagttttctctgcgagctgacatacggcgccattatgagaactgaaataactcctttggtgttgtcctatgaagaagccgatgacatattggagcatttggtggagaacttttttaacgaggtacccagcgatgatgatttttatgttccctcgcttcacgaactgtatgatattgatgtggagtctgccggtgaggattctaatgaacaggctgtgaatgatttttttccggaatcgtttattttagctgctgctgaaggggtaatattaccggagccccctgtgctttctcctatttgtgaacctattggtggtgaatgtatgccacagttgtgttctgaagatatggatttgttgtgttatgaggcggcttttccctgtagcgactctgaaggtgagcaagacgaaaacggaatggcgcatgtttctgcagctgcagcggcggctgctgctaatagagaacgtgaggagtttcagttagaccatccggagttgcctggacatgattgtaagtcctgcgagtaccaccggaatagtactggaaacactgacttaatgtgctctttgtgttatctgcgagcctacagcatgtttatttacagtaagtgcgctatttggacggtgggaggtgtattttttatttgttcttagcagtaaagacttttttgtttttaggtcctgtttctgacaatgaaccggaaccggacagcactacggatgacaatgagagaccgtcgcccccagaactgggagatgtagttccggaaggagtagtgaaacctgtacctcagcgggtgactgggaggcgacgtgctgtggaaagtattttggatttgatccaagaggaagaatgtgaacaaacagtgcctgttgatttgtcagtgaaacgccctaaatgtaattgatgaactttgcacacctggcaataaaatgggagttttgtgtgagtcacgtataataaactgtttgcgtgttttatttgggcgtggttagtaggcatataaaggtgggttggcgctgcctagcatgagatagtgaagaatggagctagaagctgtgttgcaaagttttcagagcgttcgtcagcttctgcagtatacctctaaaaacacttcaggtttttggagatatctgtttggttctactttcagcaaggtggtacatagggtgaaggaagattacagagaggaatttgaaaacatattgaccgactgtccagggcttttagcttcattagatctttgccaccactctgtttttcaggaaagagtggtcagatctttagatttttcatcttctggccgaacggttgcttctattgcctttttggtaaccgtgttggataaatggagcgagaggtcccacctgagctgggattacatgctggattacatggcaatgcatttgtggagggcatggctgaagaggagggtttgcatttactcgctggcgcggcctctaaccatgccgccgttgcaggaggagcagcagaacactacgacggaggagtaaacatggaaccacaggtgcaagaaggccatgaacctgaccccgacgaagggcctagttgtgcagatgttaaaaagcgggaaagaaaagaaagtttaaaggaagctgtccttaataggctgactgttaacctaatgtctcgcccgcgcttggaaactgtatattggcaggaattgcaggatgaatttaagcagggacacatgcatctacaatacaagtacagttttgagcagctaaaaacccactggctagaaccatgggaggatttagagtgtgctattaaagcttttgctaaagtagctttacgccctgactgtacttataatatctctaagacagtaactattacgtcatgtacgtacattataggcaatggggcagtagttgaggtggacactaatgatagagttgcttttaggtgtcgtatgcagggcatgggaccgggggtggtaggtttggatggcattacatttatgaatgttaggtttgctggagaaaaatttaagggcattatgtttgaggctaacacaagtgttgtgttgcatggtgtgtactttcttaacttcaataacacgtgtgtagagtgttggaataaggtatctgccaggggttgcactttttatgggtgttggaaggccttggtaggtaggcccaaaagtaaaatgtctgtaaaaaagtgcttgtttgagaaatgtgtgcttgctttaattgtagaaggggatgcacacattagacataatgcagcttcagaaaatacctgttttattctactgaagggaatggctattttaaagcacaatatggtttgcgggttgtctgatcagacaatgcgacggtttgttacctgtgctgatggaaattgccacactttgaaaactgttcatattgtgagtcatgctagatattgttggcctgtgtgtgaccataacatgtttatgcgctgcacaatacatttgggtctacggcggggtgtgtttagaccttcccagtgtaactttagtcattcaaatgttttgctggagcccgaggcgttttccagagtgagtttaaatggggtgtttgatttatctgtggaattatacaagattatcaggtatgacgatgctgcccgtcatcgctgccggcagtgcgaatgtggcagtagtcatctagaacttcgccccgtcatgctgaatgtaactgaggagctaagaagtgaccatcttaccctgtcttgtctgcgaaccgactatgagtctagcgatgaagacaactaaggtaagtgggcggagctatgtgggactataaaatgcttaaaggaattgtaaagttgtttttgttattttggcagcgcaatgaacggaactgctggggacaacgctgtgctttttgatggaggggttttcagcccttatttgacgtcaaggttaccgtattgggccggagtgcgtcagaatgtggtaggatctactccagacggacgacctgtagcgcctgcaaattcgtcaacgttaacctatgcaactgtgggaccttcgccgttggataccgccgccgccgctgcagcttctgcggcggcttgtacggctcgtaatatggcagctgattttagtctctacagccaattgacatcgaatgccgcaatgcgcactgcagtccgaggagacattttaactgttatgcttgcaaagcttgagaccttaactgctcagctagaggagctgtcgcacaaggtcgaagaattagctgatgctaccactcccaccctaccacaacctgttagtcaataaaaaagctttaaattgtatgctgtttgactgtttattgatgtttgttttttctgacatggtaagctctggaccatcgttccctatcattaagaacacggtgaatgtattccaatattttgtaaaggtgggcttgtatgttaaggtacattggcataagaccatctgtgggatgcaggtaggaccactgtagggcttcttgctcaggggtggtgttgtaaataatccaatcgtagcaacagcgctgggcatggtggtgaaatatatctttaagcaacaagctgattgctaagggaagacctttagtgtaggtatttataaagcggttaagctgggtggggtgcatacggggggacataatatgtagttttgattgtattttgagattggcaatatttcctgccagatctctccttggattcatgttgtggagaaccacaaaaacagtgtagccagtgcatttggggaatttatcatgaagtttggaaggaaaggcatgaaaaaatttggagacgcctttgtggcttcccagattttccatacactcatccattattatagcaattggcccgcaagcggcagctttagcaaaaatgttttttggatcagaaacatcatagttgtggtctaacgttaaatcatcgtacgagagcttaacaaatttagggcagagcgttccggactgtgggataatggttccctggggtcctggggcataatttccctcacaaatttgcatttcccaagatttaatttccgaaggcggaatcatgtccacttggggaacaataaaaaaaacagtttctggagcaggtgtgaccagctgggcggaaagcaagttacgcaacaactgagatttcccacatccagtaggtccataaatcaccccaataactggctgcaagtgatagtttaacgaggtgcagctgccgtcgtcgcggagaagcggagccacatcgttcatcatttgcttgacttgcatgttttgcttgacaagttccctcagaaggcgttcaccgcccaaggagagcaactcttgcaaagagttgaaagtttttaatggttttagaccgtcagccattggcatgtggtccagggtttgttttaacagttgcaagcggtcccatagctcagttatattttctattccatctcgatccaacagacttcctcgttgcggggattgggctggctgttgctgtaaggaacaaggcgatgagcatccaagtgcaccagggttttgtccttccatggacgtaaggtgcgtgtcagggttgtttcggtcacggtgaacggatgcgcccctggttgggcgctggccagcgtgcgctttaagctggtgcggctggtgctgaagtgtgtgtcttctccctgtgcttcggcaaggtagcattttaacatgagttcataagataaggcatccgtggcgtgacctttagcccgtattttcccctttgaagtgctgccacaatcagaacactgaaggcatttaagggcgtacagtttcggagccaaaaaaacagactctggagcgtaagcatctgcaccgcagttagcacaaacagtttcgcattccaccgaccaggtcagctcaggataagatggatcaaaaacaagtttccctccatactttttgatgcgtttcttaccttgcgactccataaggcggcgtcctttctctgtgacaaaaagactgtctgtgtctccgtatacagatttaatgggtctgtcctttagggctattccacggtcctcctcgtagagaaactctgaccactctgacacaaaggccctagtccaagccagtacaaacgaggccacatgggaagggtaccgatcgttactaattaaagggttggaactttccaaggtgtgcaagcacatgtcctcttcttcagcatctatgaatgtgattggtttgtaggtgtaagtcacgtgatcagagttccctggtggggggctataaaaaggggtgggacactgatcttcatcgctgtcttcggcttcgctgtttacgagcgccagctgttggggtgagtacgcgcgctgaaaggcaggcaacacatctgtactcaaagtatcagtttctataaacgatgaggatttgatgtgcaaacggcctgctgcaatttcttttatgagcccctcttccatttgatcagaaaaaacaatttttttgttatctaattttgtagcaaaggatccgtacagggcgtttgaaagtaacttggctatagatcttagcgtttggtttttgtccctgtctgcccgttcttttgcggcgatattgagttgtacatattcacgagcaatgcatttccaagtgggaaaaacggtggtacgttcgtctggtaataatcgcagacgccacccgcgattatgcagtgtaactaagtctacactggtgaccacttcgccgcgcaagctctcattagtccaggctaaacgaccgccttttcgagagcaaaaaggaggaagaacatctagctggttctcatctggaggatcagcatccacagtaaaaataccaggacataaaattttatcaaaataatcaattttggaagtatgattttcaagtgccacctgccattgccgtacggctaatgctctctcgtaagggttaaggggaggaccccaaggcatagggtgtgtaagggctgatgcatacatgccacaaatatcatatacatatatgggttcctgtataacacctatataggtaggataacacctgccgccgcgaatgcttgcgcgaacatagtcgtatagttcgtgcgaaggcgccaaaaggttagggcctaaatgtgtgcgttttggtttctctgcgcgatacaaaatttgtctgaaaagcgcatgagagttagaggagatggtgggacgttgaaacacattgaagtgtgcctgctgaagacccaccgactgattaacaaactgggcgtaggaactgcgcagtttttctaccaataaggtcgtaacgatgacatccagggcgcaatagtttaaagtttccagaataagattgtaatttttttctcctttttttttccatagttcttggtttaggaggtattcctgtttatccttccaatactcctctaaagggaaaccatctgcatcagcgcggtaagaaccaagcatgtaaaattgatttatggccttgtagggacaacaacctttttctacaggcagggcataagcttcagcggcctttcttaaagatgtatgagttaaagcaaaagtgtccctgaccattacttttaaatactgatatttaaagtcctggtcgtcacatcctccttgctcccacagcaggaagtcagtgcgctttttgtagtaaggattaggaagagcaaaagttatgtcattaaataaaattttaccagctcttggaataaaatttctagagattttaaatggcgcaggtacatctgaccgattgtttatgacctgcgcggcaagaactatttcgtcaaatccattaatattgtgccccactatgtataactctagaaatcttggctgccccttaatgacaggagcttttttaagctgttcaaaggtcagatcgtcaggactaactagaccattttgctgttgcgcccactgatgcaactgcggattgttttgtaaaaaagtattccagaggttagcggctaaagacgtttgcaagcgatttctgtaggtacggaattgctgaccgaccttcattttttctggggtaatacaatagaaagtagaggagtctttctcccattggtcccatccaagttctaaggcaagttgtaatgcgtgcgctacgagactactgtccccagacagtttcattaccagcataaatggtacaagttgctttccaaacgagcccatccaggtgtaggtttctatgtcataggtaataaaaagacgttcagtgcgaggatgcgaaccgaccgggaaaaactggatctcctgccaccagttggaagagtgggcgttaatgtggtggaagtagaaatctcgccggcgagcagagcattcatgtcgatgtttgtaaaagcgtgcgcagtattcgcatcgttgcatgggctgtatgtgttgaatgaggtgcacctgacgaccgcgcaccaaaaagcgcatgggaaaatggatgccacttcttggcaattgccgttcgttgtcttcctgttctgttgcattgttgtcaccgtttggatccttgaaagtgaaaacggaaagggtaacggcgcctcgaccgctgcacgtccatatttcggctcgagcggggctgaagcaggaaatcaaagcttgcagtctggaactgtccatggtatcactcataaaggaaagcgcgtctgcggggaaagcttgcaagttaacttcgcaaaggcgggtaagagcaggccgtaggtgaaggtgatacttaatttcaagaggagtgccattggtagaatctattgcgtgcagtgtgccgtaagcccgaggtgcaattactgttccgcggtgagcaacacgcctgcttaaaagcgacggcgcgcaggaactgggacttccgcttctgcgggggcatgaggcagccgtatgtcggcctgacgttctggtagtggaaggtgctgagcccgtagttgactggcatgggcgacgacccgacgattgatgttctgaatttgtcgacgttgtgtaaacaccaccggtcccgttgttttgaacctgaaagaaagttcaacagaatcaatttcagcgtcatttactgcagcctgcctcagaatttcctgaatatcccctgagttatcttggtaggcaatttctgccattagttgatcaatttcttcctcttggagatctccatgacccgctcgttcaatggtagctgcaaggtcattagagatgcgtcccataagctgtgaaaatgcgttgagtccaatttcgttccagacgcggctgtacacaactcctccgtcgctgtctctggcacgcataaccacttgcgccaagttaagttccacaaagcgcgcaaacacaccgtagttgcgtaaacgctgaaacaggtagtttaaggtagtagctatgtgttctgaaacaaaaaaataaagaatccaccgacgaagcgtgagctcgttgatgtctcccagagcttccaaacgttccatggcttcgtaaaagtcaactgcaaaagtaaaaaactgggagtttcgagccgcaacagttaattcttcttctaaaagacgaataatttcagccaccgtgtggcgcacttcaagcgcaaaagcctccggggcttcttcttcctgttcctcttctacttccattgtttcttcttgaaccgcgggcggagagggtagccttcttcgtcgccggcgaacgggcaacctgtccacaaatctttcaatcatttcgccccggcggcggcgcatagtttccgtcactgctcgaccattttcacgtgggcgaagctcgaaaagtccaccccttagttctagggtaggaaatgcgttgcgaggtgtgtttggtagcgacacagcgcttactatgcattttatgatttgctgcgtaggaactccgcgccaggacctaagcgactgcatatctactgggtctgaaaacctttcaaggaaggcgtcaatccagtcacagtcacaaggtaggctaagttttgtttgctgtgaatcaccgggatgttgaacgatgttgctaatcatgtaattaaaataggctgttttaagtctgcggatggttttaagaagcaccacgtcttttggtccggcttgttgaactcgcaggcggtctgccattccccacacactactttgacaacgtccaagatctttgtagtagtcatgcatgagcctttccactggtacttcgcggtcttggcgatcagccatgtgcgttgcaccatagccttgtaatggttgcaataaagctaaatctgcaactacccgttcagcaagtactgcctgctgtatttgggtaagagtattttcaaagtcatccatatctacaaagcggtggtaagctcctgtgttaatggtgtaactgcagttggtcattactgaccaattaacagtgtggatgcctggctgtatggtttctgtgtatcgtaagcgcgagtaagctcgagagtcaaaaacataatcgttgcaagtgcgcaccaaatactgatagcccactagaaaatgaggaggaggttctcgatataacggccaccgaagtgtagccgccgcaccgggagcaagatcttctaacatgaggcggtggtattcatatatgtatctggacatccacgtgatgccggcggcagtggttgttgcccgggcaaactcgcgaacttggttccaaatgttgcgcaggggtaaaaagcgttcaatggttgggacgctttgaccggtgaggcgtgcgcagtcttgaatgctctagatgtaaagaaaatgaaagtctgtaagcgactcccctctgtggcctggcggaaaagtcacaagggtaccacagcgaggaaccccggttcgaaaccggcaggatccgctgtgagcgtatatagggcgtctgcgcgtggaacccagccaaagacccccagacacggagaggagtcttttgtttttttttagatgcatcccgtcctgcgacagatgcgacctcaatccagggcacccacgccctcaggaccaatagcgcttgggggctctggcgaacctgaagagcctcccacgttggagttggaagaaggagaaggcttagcccgtctgggcgctcactctcctgagcgacacccaagggtgcagcttactcgcgatagtcgtgcggcgtttgtgcctcggcaaaatatgtttcgagataacagcgggcaggaggctgaggaaatgagagactgtagattcagggccggtcgcgagctgcgttgcggacttaatcgcgagcgactgctgcgagaggaagactttgagccggatgaacgttctgggattagtcccgcgcgagctcatgtttccgcggccaacttagtgtcagcctatgaacaaaccgttacagaggaacgtaattttcaaaaaagctttaataatcacgtgcgcacgctaattgcacgtgaagaagtggctattggtttaatgcatctttgggactttgtggaagcgtatgtgcataatccagcaagcaaacctttgaccgcccagctcttcttgatagtacaacatagtagagataatgaaacgtttagagacgcaatgcttaacattgctgagccacagggtcggtggctacttgatttaattaatatcttgcaaagtattgtggttcaggaacgcagtcttagtttagcagacaaagtggctgcggttaattattccatgttaagtttgggaaagttctatgctcgcaagatatacaaaagtccatatgttcccattgacaaggaagtaaaaatagacagtttttacatgcgcatggcactaaaggtactaacattgagcgacgatttgggagtataccgcaatgatcgaatccacaaagcggtgagcgcaagtcgtcgaagagaacttagtgacaaggaacttatgcacagcctgcaaagggcgctaactggagccggaacagaggatgaggccttttttgatatgggcgcagatctaaagtggcagccaagcgcccgcgccctggaggcggctggccaggatgatgatgatgatgatgacgaagaccagtatgaggactgaccgggccgtaccttttgttagatgcagcgaccggctatcatcacggacggggcccgtaacctggatcccgcggtcacggcggccatgcaaagtcagccttctggagttacggcttcagatgactggacagcggccatggatcgtattatggctttaacggcgcgcagtcctgaggcttttcgccagcagccgcaagctaatcggttttctgccattttggaagcagtagtgccgtctcgaactaatcccacccacgagaaagtgctaaccatagtgaacgctctgttggacagcaaagctattcgtaaagatgaggctggcctaatatacaacgctcttctggagcgtgtggcgcgctacaacagtaccaacgtacaggctaacttggaccggatgggtatggatgtaaaggaggcgcttgcgcaacgagagcgatttcatcgcgacggcaatcttggctccctggttgcgctaaatgcttttttaagcactcagccggctaatgttccgcgtggtcaagaagattatacaaactttataagcgctttgcgcctgatggttactgaagttccacaaagcgaagtgtatcagtctggtcccgactatttttttcagacttccaggcaggggttgcaaaccgtaaatttaagccaggcttttaagaatttgcaaggcctgtggggggtacgcgctcctgtgggtgatcgctcaactgtctccagtctgttaacgccaaattctcggttattattgttgttaatcgctccttttaccaacagcgatagtttaagtagggattcgtacctaggtcacttaattactttatatcgcgaagccattggtcaagcgcaggtagatgagcaaacgtatcaagaaataaccagcgtgagtcgcgctctgggacaggaggatacaggcagtttggaagccacgctgaactttttactaacaaaccgccgtcaacaagtgcctccgcaatacagtttgaatgcagaagaagagcgcatactgcgctacattcagcaatcagtgagcttgtatctaatgcgcgaaggcgcaacgcccagtgccgctttagatatgactgcgcgcaacatggagccgtcattctactcttccaatagagcatttattaatcgtttaatggattaccttcaccgagccgcggctatgaacggagaatactttaccaatgcgattttaaatccgcattggttaccacctcctggtttttacactggagaatttgatttaccggagggaaacgatggctttttgtgggatgatgttacagacagtctcttcagcccggcagccattggtcaccatggtaaaaaggagggagcagatgaaggtccgttactgagctctcgggcaagttctccgtttcccagcctaagcagtattaacagcggtcgtacaacaagaccgaaactatcaggagaaagcgagtatttaaatgatcccctgttacgtccagcacgcgacaaaaattttccaaataatggcatagagagcttagtagacaaaatgtctcgttggaaaacgtatgcgcaagagcggcatgaatgggaagagagacaacccaaaccagtgccccctccgagacaacgctggcaacggcgtaaaaaaggagcgcatgcgcttgacgaaggaagcgatgactcagcagatgacagtagtgtgctagacctaggagggacagggaacccatttgctcatttgcgtccgcaaggtcaactagggccgttgtattgaacaaaataaaagcactcttaccaaagccatggcgaccagcgttcgtcttatttgttttttccgttagctgcaaaatgaggcgcgcggtggaactgcagacagtggcttttcccgaggcaccaccaccctcttacgaaaccgtgatggcagcagctcagacttccgcactggaagctccctacgtgcctccccgctatttggctcctacggagggaagaaatagcatccgttattcagagttgtcacctttatacgataccactcgagtgtacctagtggacaacaagtcttctgacatcgcttctttaaactaccaaaatgatcacagcaactttctaaccactgtagtccaaaacaacgactattcccctatagaagccggtacacaaactattaattttgacgaaaggtcccgatggggcggtgatttgaaaactattttgcataccaacatgcccaacgtaaatgattttatgtttacaactaaatttaaggccagggtaatggtgtctagaaaaaaagatagtgaagaccagtccaaagacattttgaaatacgagtgggcagaatttgtgttacccgaaggtaactactcggaaaccatgactatcgacttaatgaacaacgcaatcatcgagcattacttgcgagttggccgtcagaacggcgtgctagaaagcgacattggagttaagtttgacaccagaaactttcgcctgggttgggaccccgaaactaaattagtaactccgggagtgtatactaacgaggcttttcatccagatatagtattgctaccaggatgcggagtggacttcacggagagcagattaagcaacatgctgggaatcagaaaaagacagccttttcaggagggttttgttatcatgtatgaagacttagaagggggaaatatcccagcgcttttagatgttaaaaaatacgaagacagcttgcagccagacggcaccgtaagaggtgacaactttattgccttaaacaaggccgcaaaaatcgaagcagtcgaggctgattccaaaggccgaagttacaacttgcttcccgacaaaaaaaatactaagtaccgtagctggtatttggcatacaactatggagatccagaaaaaggtgttcgttcttggactcttctaacaaccccagacgtgacaggcggttccgagcaggtctattggtcgcttcccgatatgatgcaagatccggtgacttttcgctcctcgcgtcaagtcagcaactatccggtagttgcggccgaactaatgccggttcacgccaaaagcttctacaacgaacaagccgtctactcacagcttatccgccagtcaaccgcgcttacacacgtgtttaatcgctttcccgagaaccagatactagtgcgtccaccagctgctaccatcactaccgtcagtgaaaacgttcccgctctcacagatcacgggaccctgccgctgcgtagcagtatcagtggagttcagcgagtcaccatcactgacgcccgccgccggacctgtccttacgtttacaaagcactgggcatagtttctccacgagtactttctagtcgcactttctaaaaagtgtacaaacatgtccatcttggtttcgccaagtaacaacacgggctggggattgggagctggccgcatgtacggaggagctaaaaccaggtccagccaacatccagttcgcgtccgcggacactatcgagcgccatggggagcacatacccgcggacgcactggtcgcaccactgtggacgatgttatcgactcggtcgtagccgatgctcggaaataccgtccaccagccaatacagcagggtctaccgttgatgcggtcattgatgaggtagtggcaaacgcacgagcttatgccagacgtcgcagaaggccgcgtcggcgccgacctactgctgctgtgcgtgcggctagagcgttagtgcgacgcgctagacgcgtcggacgacgagctatgctgcgagcagccaggcaggctgtaacgcctgccggtagagcgcggagacaggccgcagctgcggccgcaacagctattgccaacctagccgctcccagacgaggaaatgtgtactgggtgcgcgacgcggtaactgggactcgagtcccggttcgtacgcgtccacctcacccttagaagacaaagagttgattgataacctgttatgtatgcccagcatgaccaaacgcaagttcaaagaagagctgctgcaggccgtcgcgcctgaaatatacggcccagcggattacattaccaagcgcgaaatcaagcatgttaaaaaactggaccaaaaaaaagaggaagaaatggccgcagcgctagcggacgaagtcgacttcgtgcgctcctttgcgcccagacgtagaatacagtggaaagggcggtcagtaaagcgagttttgcgacccggcaccacaatagttttttctcctggggagcgaacggctatgcgccccctcaagcgcgaatacgatgaagtgtatgccgatgatgacattttggaacaggctgcccaacaggctggtgaattcgcctatggaaaaagaagccgttacgacgacaaaattgctattcctttggacgagggaaatcccacacccagtttaaaggctgtcactttacaacaagtattacctgtgctcgcgacctcagaagaaaagcgaggcataaaaagggaagctatgaatgacttacagcccacaatgcaacttatggtgcctaagcggcaaaagttagaggacgtactagagtacatgaaggtggatcccaacattcagccggacgtaaaaatacgtcccataaaaaaagttgccccaggattaggagtccaaacagtggacatccaaattcccgtacaagctgcgcaaagtaaaactatggaaacccagacttcgccaataaaaacagcagtggacagcggcatgcaaaccgagccttggtacccgccaacttttacaagaaaaaaacgccactacaaacaaacaaacgcgctcttgccagaatacgtgctacatccttccattgtgcccacgccggggtatcgcgggtcaactttccagcgcagagccctagtttatagccgcagaagaactccgtcgcgacgcagacgtcgacgcagagccaatttagctccagcatcagtacgccgcgttgtacgaaaagggcgcacactgacgcttccatctgtgcgttaccaccctagcatactctaataagctgcgctgccgttttacagatggctcttacttgccgaatgcgcatacccattccaggatacagaggaagatctcatcggaggagagggctgaccgggaacggtcgatttcggcgacgtagcgcgcgcaggcgcatgaagggcggggtacttcccctgctaattccacttattgccgcggccatcggagccgtacccggaattgcttcagttgccttgcaggcttctcgaaaaaattaaattaaaatcaaaagaaataaaaaaggaataacttccaacttattactggtactgtgactgttttatgcagactaaatggaagacatcaatttttcgtcgctggccccgcgacacggcacgcggccgtatatgggcacctggaacgagatcggcaccagccagctgaacgggggcgccttcaattggaacagtatctggagcggtcttaaaaattttggttccacaattaagacatatggctccaaggcgtggaacagccaaaccggccagatgctaagggacaagttaaaagaccagaacttccaacaaaaagtggtagacggtctggcttctggaatcaatggagttgtagacatagctaatcaagctgtgcaaaaacaaattgccaaccgtttagagccgcgacccgacgaagtaatggtagaggaaaagttaccgcctctggaaacggtgcccggatcagttccgtccaaaggagaaaagcggccgcggccagatgcagaggaaactctagtcacgcacaccatagagcccccttcctatgaggaagcagttaaacaaggagcagctttggcacctactacttatcccatgaccaagcctattctacccatggctaccagggtgtatgggaaaaatgaaaatacgcctatgactctcgagattcctcccttgccagaacctactgttgcggaacctgtggttactgctcccattgtttcaactgtatcgcgtccagaagtgcggcctgttgccgtagcaagctcacgaaacccgcgatccgctaattggcaaagcaccctaaacagcattgtgggactgggagtaaagtctttaaaacgcagacgctgctattaacattaaacaaaacatagtgttaactcccgtctgtatacgcctctatgttagcgccagaggaccaacgctcgaattgcagttattaccagcgctttcaagatggccactccctcgatgatgccgcagtggtcttacatgcacatcgccggtcaggacgcctcggagtacctgagtcccggtctggtgcaattcgcccgcgccacggacacctacttcaccctgggaaacaagtttaggaatcccactgtggctcccacccatgatgtcaccaccgaccgctcgcagcgattgacgctgcgttttgtgcccgtggatcgggaagatactgcttattcttacaaggctcgctttacgctggctgtgggggacaatcgcgtgctggacatggctagttcttactttgatattagaggggtgctggatcgcggtcccagttttaagccttattcgggtaccgcctataactcactggcgccaaaaggcgcccctaatgcttcacagtggtctgataataataaggtgaacacttttgggcaggctccgtatcttagtgactctattactgccgatggtattaaagttggaacagataccgcccaagcaggggcggcggtttacgctgacaaaaaataccagcctgagccgcaggtaggggcaagtgaatggaataccagtattacaaacgttaaagcagggggtagggcattaaaacaaacgactgccatgcagccgtgctacggctcatatgctcgcccgaccaacgaaaaagggggacaaaccaaggacaataacgtagaacttcggttttttgacacagccaacaatgcagccactcctcaagttgtgttttacactgaagatgtaaatctagaaatgccggacacccatcttgtgtttaagccggctgttcctaatggaacaattgcgtccgagtccttgttgggacagcaagcagcgccaaatagagcaaattacattgcattcagagataactttattggattaatgtactacaacagcacagggaacatgggtgtccttgccggacaagcttcacagctaaacgcagtagtggacttacaagacagaaatacggagctgtcttaccagttaatgctagatgctcttggcgacagagcgcggtatttctcactgtggaattctgcagtggacagttacgaccctgatgttcgcatcattgagaatcatggggttgaggatgaactcccaaattattgctttcctctcagcgcagtgggagacataaagagttacaaaggcattaagcaaaacaacggagggggcggtaactgggctgcggacgacactgttggcgacaaaaacgatataggcattggtaacattgccgctatggaaattaacttgcaggccaatttatggagaagttttctgtattcaaatgtggggctgtatctgcctgacgacttgaaatacacccccgggaacataaaacttccagaaaacaaaaacacctacgagtacatgaacgggcgcgtgactgttcccggtttggtagatacctacgttaacattggcgcgcgctggtctcctgatgtaatggataacataaacccttttaaccaccaccgaaacgcagggttgcgctataggtccatgttactgggcaacggtaggtttgttccgtttcacattcaggtacctcagaaatttttcgctattaagaatttgctgctgttaccagggtcctacacttatgagtggaacttcagaaaagatgtaaacatgatacttcagagcaccctgggcaatgatcttagagtggacggagccagcattcgctttgacaacattgccctgtatgcaaacttcttccccatggctcacaatacagcttctacattggaagccatgctgcgaaatgacaccaatgaccagtcttttaacgattacttgtgcgcggcgaacatgttgtatcccattccagcaaatgccaccagcgtgcccatttcaataccttcgcgaaattgggcagccttcagagggtggagttttactcgccttaaaactaaagaaacaccttctcttggttcagggtttgacccctattttgtttactctggaactattccctacctggacgggactttttacctgaaccacacttttaaaaaggtgtcaatcatgtttgactcctctgtcagctggcctggaaatgacaggctgttaacaccaaatgaatttgaaataaaacgttctgtagacggggaaggctacaatgtggcccaatgtaatatgaccaaagattggtttctaatacaaatgcttagtcattataatattggataccagggtttctacgttccagagagctacaaagaccgcatgtattctttcttcagaaactttcagcccatgagcaggcaggttgtagacactactgaatacaaagagtataaaaaagtaaccgtggaattccagcataacaactcagggtttgtgggatacctgggtcctactatgcgcgagggacaagcttatcctgcgaactatccctatcctctcattggaaaaacagctgtacagagcgtcacacaaaaaaagtttctctgtgaccgtgtgatgtggcgcattccattttctagcaattttatgtcaatgggggcgttgacagacctcgggcaaaatatgctgtatgcaaattcggcccatgcgttagatatgacatttgaagttgaccccatggaagagcccacccttctttatgttttgtttgaagttttcgacgtggtgcgcattcatcagccacaccgcggagtcattgaagcggtctatctgcgcacacccttctccgcgggtaacgccaccacctaaagaaggcactttcccagatcgctgtaatgggttcaagcgaacaggagctgacggcgattgttcgagatctaggctgtggaccctattttttgggcacctttgacaaacgttttcccggttttgtgtctcgcgaccggttatcatgcgctattgttaacactgccggtcgcgaaactgggggcgtacactggctggcctttgcatggaatcccaaatcgcacacttgctatttatttgatccatttggattttctgatcagcggctcaaacaaatctatcagtttgagtacgaaagtctgttgcgtcgtagtgcgctagcggctactaacgaccgatgcgtcaccttagaaaagtcaacacaaactgtacaaggaccgttttctgcagcgtgcggcctgttttgttgtatgttcttacatgcttttactcactggcctgaccatccaatggataagaatcccactatgaatctactgactggggttccaaatagtatgttacaaagtccgcaggtggaggacacactgcggagaaatcagcaagaactatatattttcttaaacaaattgtcaccttactttcgcaacaaccgccaacgcatagaaaaagccacctctttcactaaaatgaaaaattgatacaaatacccatgtacgtaatgcattaataaacaattttattagagaattgattacaagactgttttttttttttttattttattaaaaatcaaacggttcctcgcgagaatcaccatggttggtgggcagggctatgtttctatactgcaaacgcggatgccacttgaactctggaataacaagccgaggaagcgggccttcgaaattttctccccatagctgtcgcacaagctgcaatgcacccataacatcaggagctgatatcttgaagtcgcaattaggaccggcgttaccgcgcgcattgcgataaactggatttgcgcactgaaaaaccagcaaacatggatacttaatactggctagggctccagggtcggtgacttcgttaacgtcgatgttttcaacattgctgaggttaaatggagtaattttacacagctgacgccccatgcgtggcaggccatcttgcttgtttaaacattcacaacgaactggcatcaggaaccgcttctgcccctgtcgcatgtgagggtagtcggccaacatgaaagcttcaatttgcctaaaagccatttgagccttcgttccttctgaataaaacaaaccgcatgactttccggaaaaagaattatttccgcagccgacatcattaaaacagcagcgggcgtcgtcatttttaatttgaactacattacgcccccagcggttttgcactaccttggctttagatggattttcttttagtgctcgctgcccgctctcgctggttacatccatctctatcaagtgctctttgcgcaccatttccatgccgtgcaggcatctcagctccccttcgcgttcagtgcactggtgctcccatacacagcaaccagttggttcccaggtattttgttgaacaccggcataggcttgcatatatccttgtaagaagcgtcccataagctcctgaaaggttttctgggatgaaaaagttagctgcaacccgcgtttttcctcatttagccatgttgtacaaatttttttgtacaccgctccctgatctggcaaaaacctaaagctggcgcgctcgtcgtgatccacatggtacttctccatcagcatagccattgcctccatgcctttttcccaagctgatatcagaggctcgctcgtggggttgcgaactattactacgcctttttgttctttgccttccatgttttgagcagcggtcttcaaaatgcgcacctgcctttcttccattttttggaaagactgagaaccgtctgcatgatgcataatgcgaacagggggcatgctgaaacccatgactcctaacactgcctttggcggctcggtttcttcttctttttcgctctccggagatagagggatggtagccatggacctcctggcttttttctttggaggcaaaggcacagcctccaggtcttcttcgctttctgagtccaaaaagtaccgacccatttttggaggcggcggctgagtgttgcggtctggggtgcgctccctctgtgggtgttgattgctggccattatttaatcctaggcaaagaaacacatcatggatccgcagtcaaaggaaaacttaaccgcccccaccgatactgctgttgctgccatggaaaagaacaaatgtctactcataccccaagatgcaccgcttgcgcaggactcgggctacgtgactccccccgaggaattggaaggctctcttctaatccaagagcaaccaaataaggaacaggcagaaagcaatgagcaaaacgctgggctccatgactacctagacaagggagatgtcttgcttaaacatttacagcgacaaagcattattgttcgcgacgccgtagctgaccgctctttattgccagtttcaatcgcggaactttcttgcgcatacgaacgcaacctcttttctccccgtgtgccacccaaacgacaagccaatggtacctgcgaaccaaatcctcggctgaacttttacccggtttttgcgataccagaagctctggcaacatatcacatttttttcaaaaatcatagaatacctctgtcttgccgagccaaccgcagtcgcgcagataagctccttacccttagcggtggtgcttccatacctggtatagtgtccttggaagaggtgcctcggattttcgaaggcttggatcgcgacgaaaagcgagcagcaaacgccctacaaacagaaaacaagcaaaatcaaagtgcgctcatagaactagaaggggacaatgcccgtttggccattttaaaacgcaatgttgaagtaactcacttcgcatacccggcagtgaatcttccgccaaaggttatgagcgcagtaatgaatcaactactaattaagcgcgcccagcccattgacaaagatgcaaacttgcaagattcagaggcatcagatgatggaaaaccagttgtaagcgacgaacagctaattaaatggctgggaacagacgaccccgccaaactacagcagcggcgtaaacaaatgatggcggcagtacttgtaacggtggaactggagtgcatgcaccgttttttttccaacgttagcacgttgcgcaaaattgaagaatgtctccactacacctttcggcatggttatgtgcgccaagcctgcaaaatttccaatgtggagctaagcaaccttatctcatacatgggtattttgcacgaaaacagattgggacaaagtgtgctacattcaacgctccgcgacgaagcgcgcagagattacgtgcgggactgtatttatctttttttgctacatacttggcaaaccggaatgggggtgtggcaacaatgtttggaagaaactaacctcagagaactcaacaaactgcttgacagagcgttgaaatcactatggacaggtttcgacgaaagaacggtagcggcagatctggccaacatcatttttccagaacggctcatgataaccttgcaaaatggtctgcctgactttatgagtcaaagtatgctgcataattaccgttctttcatattggagcgatctggcttgttacctagcatgtgctgtgcgcttccttcagattttgtgcccatacattttagagaatgtccccctcctctgtggagtcactgctacttgttcaaacttgccaattacttagcttaccactcagaccttatgacggattccagcggagaaggattaatggagtgtcactgtcgctgcaatttatgcactcctcaccgttcgctggtgtgcaataccgaactgcttagtgaaagccaggttattggtacgtttgaaatgcaagggccgcactctgatagcaatctcaccacaaacctgaggctgacacctggcctttggacttccgcttacctgcgcaaatttgaacccctagattaccacgcacacgttattaatttttatgaagatcagttaaagccccctaaagcgccactaacggcctgcgtcattacgcagggaaaaattttagcccaattacaagccattaaacaagcgcgcgaagaattcttactcacaaaaggacgcggagtgtaccttgacccccagaccggcgaggaactgaaccttccatcacctctgtgtgctactgcatcctctccccattcgcagcatgtccccgaaaaccgcaaaacaagctattgcgcagcaacgctcaaagaagcagctacaacagcaggaaatctgggaggaagattcttgggacagtcaggcacaggaggaccaggacttggaagaatgggaggaggaaagcctagacgaggatccagaggaggacggttccaaggacggagcgaccgccgcaaaaccgtcgctttcaaccgaaccctctccagtgaaacacactgtcaacaaatctcagaaagcgagccgtagatgggacaccactgaagccagcgtcgtaaacatgggtaagaaatgcaagcaggtgcggcggggctactgctcatggcgggctcataaaagtaatattatagcctgcttgcaacactgcgggggaaacatctcatttgcaaggcggtatctgctctttcacgatggagtggcaattcctaggaatgttctccattactaccgtcatctctacagccccttcgaagagatccacaaagaatcgacgtcttacggaccagcaggccactagaaaaaccggcagcagcaacaaggaaagtccagaggcgcgcgagttaagaaaacgcatttttcccactctatatgctatttttcagcagagccgaggccaagaacacgaactgaaaataaaaaacagatccctccgttcacttacccgcagctgtctctacctcaaaagcgaagaccagttgcaacgcaccttgcaggacgctgaagctctgttcaataaatactgctccctctcgcttaaagagtaaaaaaagcccgcgcgcggacttctgacaagcgggaaagtgacgtcacatttataacaggatgagtaaagatattcccacgccttacatgtggagttttcaacctcaaatggggctagcggcgggtgcggctcaagactactctactaaaatgaattggttgagcgccggcccacatatgatttcccaagtaaatggaattcgcgcccggcgaaaccaaatgctactacaacaagccgctctcaccgctacaccgcgtaaccagcttaacccaccctcttggccctctgccctattgtaccaggaaagtccccctcctacaacggtacttttgcctcgcgacgcccaggccgaagtccgcatgactaatgctggcgcacaactcgcgggcggcgcacgtcatagtttcaggtataaaggtcgccctgggccgtactcatcttctgctataaaaacaatacgcattagaggaaaaggtattcagctgaacgacgaggcaacatcgccactgggactcaggcccgacggagtgtttcagctggcaggctccggccgctcgtccttcactactcgtcaagcctacctaacacttcagagttcgtcaacagctccaagatccggcgggattggaactcttcaatttgtggaggaatttactccatctgtttactttaatcccttttcgggctcgcctggacactatcctgacgccttcatacccaactttgacgccgtgagcgaatctgtggatggttatgattaatgtctaatggagcggccgacagagcgcggctgcgacatttagaccactgtcgccaacctcgctgctttgctcgagacatctgcgtgtttacttactttgagctgccagaggaacaccctcagggaccagctcacggcgtaaggataacagttgaaaaaggaattgatacacacctcattaaattttttaccaaacgtccgctattggttgaaaaggatcaagggaatactgtattaactctatattgcatttgtcctgcccccggattacatgaagatttttgctgtcatttgtgtgctgaatttaatcatttgtagtggcggtttaccgcctgaagaagaacctaactgtcatccgcctctcagtaacattaaaattaacctttcaatctctgacattactcttcgctgcaattttttctccacccatctcacctggagttttaacggaaaacccgtcgccgaggtaaaattaaagtttgagctacacaaagaaaacatcactttatttgcacctattcacctgggatactaccgctgcgcagctccaccctgtcagcaagcctttttcgtttctccgattattaacagaaaacctgctacaacaacacctgttactcggcaaaacatccagacgacttctcctactaaaggtatagaggaaattgtgtacttttcaaactttacaaaccacatacttttaaactgttcctgctctaactccttaatctcatggtttgctaatagcactttgtgtaaagctttttaccaacaaaaacttttgtattctgccaatttaacactgtgtaaccaaaccacttcttcccaccttactctactaccaccttttgtcgctggtcgttatttttgcttaggagctgccggtactagcccctgtcaacagcattggagattaacttatcgcccaacgccagtaacgccttctgtaataacagaggctttcacctctaataccctgcttctatatagtggtcttgtggctcttactttatttctaatttctaacttgtttctagtgcagcatctgtatttgtactaatcatgcttagtattttagtctttgtttttttacctctcctcctacatgctcaaacatctgagaaaccattgaaagtatttgtggaagttggccataatgtaaccctcccccatctcatgcctgattcacacgaaacaggccatgtgacttggctagtagaaacatcagattacggtgtagcttctccaaacaactttatttttagtggacaaaaactatgccagtttacttccagaactatggtgtggccttatgccaatttagattttaactgcgctaattacgacctccatttgtttcggcttaaggtagaaaattcagcaatttacaatgttaaaaataccatcaatgcatctgaaatgaacatctactaccaattaacagtaattgacattcttccacccaaatgcatcattacttcaaagtacctcacaaataattattgtcacattaccattaactgcaccaactcagtgtatccaaacaaagttcagtttaataatgttagtcgattctattatggatacgccaagggaggcccaaacctacccaattattttaccactaatttcaatgtatcaggtattactaaaagctttaaccacagttacccttttaatgagctgtgtgatgaccccgtgttccaacctcagaataatttaacaaacacggtaattttcttagtaataattgcatttagcgttctcattattatagcggccctcacttacctgtgctgtcacaaacagacttaaatcttgctttttttttttcttacagtatggtgaaggttcttcttatattcttatgcctgccaatcattttttcttcttcaacttttgcagcagtgagtcacattgatcctgattgtatagcaccctttgcggtgtatttgatttttacatttgtgaccgccacgtgcgtctgcagtcttataactttacttcttacctcgcttcaattttttgattactactacgtgcgatacgtttaccgcagacatcaccctcgctatcaaaacccccaaattgcagctcttcttcatctacagccatgaaagcagcgttagccatcttcatgttaactccaatgttggccacttcttgtaagcttcacgtgccatggactttcttagactgctacaccaaagagacagattacataggctgggtgtatgggattatgtctgtcttagtttttgtatcctgtgtagtttccttaaaactttatacgcttattaattttagttggaatcaatacactgatgatctccctgagtacccccaccaccaggatgatttacccctaaacattgtacttccacagcccccacgtcctccttcggttgttagctattttaagttcgccggtgaagatgattgaaccagacctacaaatggatggaacaatgaccgaacagaggctgcttgctgatcgcgctaggcgtcgccaacaggatcaaaaaaataaagagttacttgatttacaaaccgttcatcagtgtaaaaaaggacttttttgcctggtaaaacaagccaccctccgctacgagagtttaccaggcaaagagcatcaactctgctacacgctgcctgctcagcgacaaagcttcaccgcagtcgtgggttcggtgcctattaaagtgtcccaacaagcaggacagcaagaaggctccatttgctgcctatgtaacagccctgaatgtttgtacactttaataaaaacactgtgcggcataagaaatcttttaccaatgaattaaataaatcactcacctgaaatttaaaaatacattgtggtctccatgtactcttacaaaatttccttcttcccaactatcaaagccaatagacttgcaaacagcaaattttctccaaattttaaatggaatgtcagaattttcttcccaattcctacccaccatcttcatcttttttagatgaagcgcagcagaacccagtacgctgaagaacctgaagaaaatgacgacttcaaccccgtttacccttttgacccatatgacacagcgcatgtgccctttgttacacccccttttacttcttccaatgcttttcaagaaaaaccacccggtgtattatcacttaattacaaagatcccattgttactgaaaatggatcccttaccctaaagttagggaacggaataaagcttaattcacaaggtcaacttacaaccactaacactaaagtactagaaccccttgcccacacctcacagggtcttacactttcttggagcgccccattatcagttaaggccagtgcacttacacttaatacaatggcaccattcacaacaacaaacgaaagcttaagcttggtcactgcccctcccattacagtggaagcttcacaattgggcttagccactgtagcacctctaagcttagacggagggggaaaccttggtttggatcttctcgctcccttagttgtaaactctagcaacgcgctaaccctatctgcttcagatccgttaactgtaaattccaatagtttaggattaaatattaccagtcccattacactaataaacggatccttggctttagccacatcccctcctctggacaccacaggatctactttaaatctttctgttgctgctcctctcagtgtttcacagaacgcactcactgtttcaaccggtaatggtcttcaagtatcaggatctcaattagtaacaagaataggagatggtttacgatttgataatggggttataaaagcatatgttgccgggggaatgagactctcagggggtaaaataattttagatgttaattatccctttgatgcaagcaacaacctttcattgaggagaggatcaggcctcatatataatgagtctacaaactggaacttaacaactgatatcagcaccgaaaaaggcctaacgtttagtgggaaccaaatagctatcaacgcaggtccaggtctcacgtttaataaccgcaagcttcaggtaaaattgggcgcgggactcacttttgattcaaatgataatattgccttaaatagtattgctactccgtatgatcctttaacgttgtggacaactccggatcctccgcccaactgcactctcagacaagaacttgatgcaaaactaactttgtgtttaacaaagaacgaatctattgtgaatggcatagttagtttgataggtgttaagggggatctcttacatattcaacctaccaccaccactgtgggactgcatttagtgtttgatcgacagggacgattggtcacaacaacgcccactgccttagttccccaggcttcctggggatataaacaaggtcaatcggtatctagcagcgctgttgctaatgctttaggattcatgcctaatgtaagtgcttaccctagaccaaacgcgggtgaagccaaaagtcagatgttaagtcagacatatttacagggagatacaactaaacctattacaatgaaagttgtatttaatggcaatgcaacagtggatggatactctctaacatttatctggacaggtgtgtcaaactatctaaaccaacagttttcaacaccatcttgttcattttcgtatattgcccaagaataaaaaaaacacaaatttgcataccgtgatcatttattaattcttttttacaatacgagtagttatactgccttcttcccatttcaccttgtatacctccctctcccactttgttgcggaaaacagctgcgcttgaatgtttctactttggttttttggtgttaacgtccacacggtttccttctgggcaaaacgacagtcggtgatacaaacaaatccttcgcccgcacagtctcttaaactgcattccattttatcctacaaaaggtaacaacagtcagtgtccatcagccgcccatgggttttctcgatgattgtaatctccaaataaaattgcttgatgatgcataataagaccctttagcagtcgctgacgatggccttcgcaccaactatgttttagtgggcgaacagtgttctcagcaattactttaacaacttttaacattaatagtctggtacgacgagcgcaacagcgcatgcgtatttcacttaagtctttgcaatagtcacagcacaacactaacatgttatttaaaattccataattaaaggtactccatccaaaactaatcttttctagcgctaaccaagcatggccatcatacataattttaacataaatcaaatggcgacctctaacaaaggtgcttcccacatacattatttcttttggcataaaatggttaacaacctcccgataccaaaaacaccttttgttaattaatgttccatatacagccattttgaaccagcgtcctaaaagcatcccagctgacatacactgtagtgaacccggacgctggcaatgacaatgtattagccaccgctcataaccatgtaacaattgagtaatttcaacatctatggtggcacaacacaaacacacactcatgtatttttttaaaataaacatctcataattagttaaaatcatatcccatggtattggccattcttgcaatacagtaaaccctacacatgaaggaatacctcttacctcacttacattatgcaaagtcagactattacactcaggccatgcagaattctctgacaaagtagcttttgactgctgttcacaaggtggtagatggtacttgctgtacggcgccagtctgcaaccataccgtctgtcgcgctgcatcgtacaccacagacttgcgagcgtcttcgtactttgaataacaaaaccacgtacgcccactggttacagcgccgcgtcccttttgctttcgacgttggcgttcagtcacaaacgcaaaatataaccactctcgcaggcttaatagaatgtactcagcttcaggtgtgatcttcaaattatgctctttaacaaagcggatagtatccacacaggtcgcatgggccaaaccaagccatccaatacaggcagctgtatcccgacatatgggaggttgaggaatacaaggcaaaggcataaaagctaatcaagacggtcagcaagtatttgaatgcgtaaatctcgcaggtggcagcgatcacctccgctgtgctggtgaaaaatcacagccagatcaaattgtaagcggttttccaaatgttcaacaacagcatctaaaagagccacggctctaatttccacaaacaaaagtaaagcaaatgcgttatcatgaaactcttctatcatcagactgcctgactgaaccattcccaaataattttcattcttccactgttgtattatttgaacacactgattttgcaggtttaagccatgaatattaaaaagctctgtaagggcgccctccaccgccatccgcaggcagtacttcatatttgctgaaaaaagtctggatcttcaaacacctgcagtaaattcagtagatttacattaggctccacaccttgctctcgcagctgacatcttaaagccagttgtataaaatcatgcaaatcagaagccag

SEQ ID NO: 1444 - DNA, 32767 bp, Human mastadenovirus D
catcatcaataatataccccacaaagtaaacaaaagttaatatgcaaatgagcttttgaattttaacggttacggggcggagccaacgctgattggtcgagaaacggtgatgcaaatgacgtcacgacacacggccgacggtcgccgcggaggcgtggcctagcccggaagcaagtagcggggctgatgacgtataaaaaagcggactttagacccggaaacggacgattttcccgcggccacgcccggatatgaggtaattctgggcggatgcaagtgaaattgggtcattttggcgcgaaaactgaatgaggaagtgaaaagtgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgcctcctgcctggaactgtgcccttggacatggccgcattattgctggatgactttgtgagtacagtattggaggatgaactgcaaccaactccgttcgagctgggacccacacttcaggacctctatgatttggaggtagatgcccaggaggacgacccgaacgaagatgctgtgaatttaatatttccagaatctctgattcttcaggctgacatagacagcgaagctctacctactccacttcatactccaactctgtcacccatacctgaattggaagaggaggacgagttagacctccggtgttatgaggaaggttttcctcccagcgattcagaggacgaacagggtgagcagagcatggctctaatttcagactatgcttgtgtggttgtggaagagcattttgtgttggacaatcctgaggtgcccggggaaggctgtagatcctgccaatatcaccgggatcagaccggagaccctaacgcctcctgcgctctgtgttacatgaaaaagactttcagctttatttacagtaagtggagtgaatgtgagagaggctgagtgcttaacacatatctgtgatgcttgaacagctgtgctaagtgtggtttatttttgttactaggtccggtgtcagaggatgagtcatcgccctcagaagacgaccacccgtctccccccgatctcacagatgacacgcccctgcaagtgatcagacccaccccagtcagactcagtggcgagaggcgaatggctgttgacaaaattgaggacttgttgcaggacatgggtggggatgaacctttggacctgagcttgaaacgccccaggaactaggcgcagttgcgtttagtcatgtgtaaataaagttgtacaataaaagtatatgtgacgcatgcaaggtgtggtttatgactcatgggcggggcttaatcctatataagtgctaacacctgggcactcaggcacagaccttcagggagctcctgatggaggtgtggactatccttggagactttaacaagacacgccggcttgtagaggatagttcagacgggtgctccgggttctggagacactggtttggaactcctctatctcgcctggtgtacacagttaagaaggattataacgaggaatttgaaaatctttttgccgactgctctggcctgcttgattctttgaattttggccaccagtcccttttccaggaaagggtcctccacagccttgatttttccagcccagggcgcactacagccggggttgcttttgtggtttttctggttgacaaatggagccagaacacccaactgagcaggggctacattctggacttcgcggccatgcacctgtggagggcctgggtcaggcagcggggacagagaatcttgaactactggcttctacagccagcagctccgggtcttcttcgtctacacagacaaacatccatgttggaggaagaaatgaggcaggccatgtacgagaacccgaggagcggcctggaccctccgtcggaagaggagctggattgaatcaggtatccagcctgtacccagagcttagcagggtgctgacatccatggccaggggagtgaagagggagaggagcgatgggggcaataccgggatgatgacagagctgacggccagtctgatgaatcgcaagcgcccagagcgcattacctggcacgagctacagcaggagtgcagggatgagataggcctgatgcaggataaatatggcctggagcagataaaaacccactggttgaacccagatgaggattgggaggaggccattaagaaatatgccaagatagccctgcgcccagattgcaagtacagggtgaccaagaccgtgaatatcagacatgcctgctacatctcagggaacggggcagaggtggtcatcgataccctggacaaggccgccttcaggtgttgcatgatgggaatgagagccggagtgatgaatatgaattccatgatcttcatgaacatgaagttcaatggagagaagtttaatggggtgatgttcatggccaacagccacatgaccctgcacggatgcagtttcttcggcttcaacaatatgtgtgccgaggtgtggggcgctgctaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacattgctcttccttggagacgggctgcttctgcctggtgaagggcacagcctctctgaagcataatatggtgaagggctgcacggatgagcgcatgtacaacatgctgacctgcgactcgggggtctgtcatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgcttgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagccctgagccgccagctggccgcactgacccagcaggtgtccgagctccgcgaacagcagcagcaaaataaatgattcaataaacacagattctgattcaaacagcaaagcatctttatttattttttcgcgcgcggtaggccctggtccacctctcccgatcattgagagtgcggtggattttttccaggacccggtagaggtgggattggatgttgaggtacatgggcatgagcccgtcccgggggtggaggtaacaccactgcatggcctcgtgctctggggtcgtgttgtagatgatccagtcatagcaggggcgctgggcgtggtgctggatgatgtccttgaggaggagactaatggccacggggagccccttggtgtaggtgttggcgaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcgtaattatgctcctgggtgagatcatcataagacattttaatgaatttggggcggagggtgccagattgggggacgatcgttccctcgggccccggggcaaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggagatgcagctgccgtcgtcccggaggaggggggccacctcgttgagcatgtccctgacttggaggttttcccggacgagctcgccgagaaggcggtccccgcccagcgagagcagctcttgcagggaagcaaagtttttcaggggcttgagcccgtcggccatgggcatcttggcgagggtctgcgagaggagctcgaggcggtcccagagctcggtgacgtgctctacggcatctcgatccagcagacttcctcgtttcgggggttgggacgactgcgactgtagggcacgagacgatgggcgtccagcgctgccagcgtcatgtccttccatggtctcagggtccgcgtgagcgtggtctctgtcacggtgaaggggtgggccccgggctgggcgcttgcaagggtgcgcttgagactcatcctgctggtgctgaaacgggcacggtcttcgccctgcgcgtcggcgagatagcagttgaccatgagcttgtagttaagggcctcggcggcgtggcccttggcacggagcttgcccttggaagagcgcccgcaggcgggacagaggagggattgcagggcgtagagcttgggtgctagaaagacggactcgggggcgaaagcatccgctccgcagtgggcgcagacggtctcgcactcgactagccaggtgagctcgggctgctcggggtcaaaaaccagttttccaccgttctttttgatgcgcttcttacctcgcgtctccatgagtctgtgtccgcgctcggtgacaaacaggctgtctgtgtccccgtagacggacttgatgagcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccactttttccacggtatgcagacacatgtccccctcctccgcatccaagaaggtgattggcttgtaggtgtaggccacgtgaccgggggtcccagacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgttggagagaagcttggcgatggatctcatggtctgatttttgtcacggtcggcgcgctccttggccgcgatgttaagctggacatactcgcgcgcgacgcacttccattcggggaagatggtggtgcgctcgtcgggcacgatcctgacgcgccagccgcggttatgcagggtgaccaggtccacgctggtggccacctcgcctcgcaggggctcgttggtccagcagagtctgccgcccttgcgcgagcagaaagggggcagcacatcaagcaggtgctcgtcaggggggtccgcatcgatggtgaagatgcctggacagagttccttgtcaaaatagtctatttttgaggatgcatcatctaaggccatctgccactcgcgggcggccattgctcgctcgtaggggttgaggggcggaccccagggcatgggatgcgtgagggcggaggcgtacatgccgcagatgtcatagacatagatgggctccgagaggatgccgatgtatgtgggataacagcgccccccgcggatgctggcgcgcacatagtcatacaactcgtgcgagggggccaagaaggcggggccgagattggtccgctggggctgctcggcgcggaagacgatctggcgaaagatggcatgcgagtttgaggagatggtgggccgttggaagatgttaaagtgggcgtgcggcaggcggaccgagtcgcggatgaagtgcgcgtaggagtcttgcagcttggcgacgagctcggcggtgacgaggacgtccatggcgcagtagtccagcgtttcgcggatgatgtcataacccgtctctcctttcttctcccatagctcgcggttgagggcgtactcctcgtcatccttccagtactcccggagcgggaatcctcgatcgtccgcacggtaagagcccagcatgtagaaatggttcacggccttgtagggacagcagcccttctccacggggagagcgtaagcttgagcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgctcgcggcatgaaattgcgggttatgcggaaagggccaggcacggaggctcggttgttgatgacctgggcggcgaggacgatctcgtcgaagccgttaatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcttgcatgaaggaagcccagagctcgcgggccatgagggtctggagctcgtcgcgaaagaggcggaactgctggcctacggccatcttttcgggggtgacgcagtagaaggtgagggggtcccgctcccagcgatcccagcgtaagcgcgcggcgagatcgcgagcgagggcgaccagctcggggtcacccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccactggccccgtgactttgaacctgaaagacagttcaacagaatcaatctcggcgtcattgacggcggcctgacgcaggatctcttgcacgtcgcccgagttgtcctggtaggcgatttcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcgtagttgcgcaggcgctggaaaaggtagttgagggtggtggcgatgtgctcggtgacgaagaagtacatgatccagcggcgcaggggcatttcgctgatgtcgccgatggcctccagcctttccatggcctcgtagaaatccacggcgaagttgaaaaactgggcgttgcgggccgagaccgtgagctcgtcttccaggagcctgatgagctcggcgatggtggcgcgtacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtctcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagtgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctttcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccataagcgaccagttaacggtctgcaggccgggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccagatcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcggcagaaaatcccgccgggtagtggctcgcgcccgtagtctggagaagcatcgccagggttgagtcgcggcagaacccggttcgcggacggccgcggcgagcgggacttggtcaccccgccgatttaaagacccacagccagccgactctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagacttggggcgccgtccccggagcgacacccccgcgtgcagctgcagaaggacgtgcgcccggcgtacgtgcctccgcagaacctgttcagggaccgcagcggggaggagcccgaggagatgcgcgactgccgttttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaagccatcgtgcagaatccggacagcaagcctctgacggcgcagctgttcctggtggtgcagcacagcagggacaacgaggcgttcagggaggcgctgctgaacatcgccgagcccgagggccgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgttgagcctgcgccgggcgctggtagggggcgccgctggcggcgaggagtcctacttcgacatgggggcggacctgcattggcagccgagccggcgcgccttggaggccgcctacggtccagaggacttggatgaggatgaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaatcccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcactgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaactttttgctgaccaatagacagcagaagatcccggcgcagtacgcactgtcggccgaggaggaaaggatcctgagatatgtgcagcagagcgtagggctgttcctgatgcaggagggcgccacccccagcgccgcgctggacatgaccgcgcgcaacatggaacctagcatgtacgccgccaaccggccgttcatcaataagctgatggactacctgcaccgcgcggcggccatgaacacggactactttactaatgctatactaaacccgcactggctcccgccgccggggttctacacgggcgagtacgacatgcccgaccccaacgacgggttcctgtgggacgacgtggacagcgcggtgttctccccgaccttgcaaaagcgccaggaggcggtgcgcacgcccgcgagcgagggcgcggtgggtcgcagcccctttcctagcttagggagtttgcatagcttgccgggctcggtgaacagcggcagggtgagccggccgcgcttgctgggcgaggacgagtacctgaacgactcgctgctgcagccgccacgggtcaagaacgccatggccaataacgggatagagagtctggtggacaaactgaaccgctggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggcgtcggatgttttgaaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaaaaaggcggaaggggctgatgcaaatgataggagcaaggatatcttagagtatcagtggtttgagtttaccctgcccgagggcaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtactgctgccgggctgcggggtggacttcaccgagagccgcctgagcaacctcctgggcattcgcaagaagcaacctttccaagaaggcttcagaatcatgtatgaggatctagaagggggcaacatccccgccctcctgaatgtcaaggagtatctgaaggataaggaagaagctggcacagcagcaggaaaagaaattgagttgaaggccattttgaaagatgattcagacagaagctacaatgtgatcgagggaaccacagacaccctgtaccgcagttggtacctgtcctatacctacggggatcccgagaagggagtgcagtcgtggacactgctcaccactccggacgtcacctgcggcgcggagcaagtctactggtcgctgccggacctcatgcaagaccccgtcaccttccgttctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccggccgcccgcgcccaccatcaccaccgttagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgttatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgagctctgctgcgccgcgccagacgcacgggtcgccgggccatgatgcgagccgcgcgccgcgctgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggaactgatctcgctgccgctggacgagagcaaccccacgccgagcctgaagcccgtgaccctgcagcaggtgctgccccaggcggtgctgctgccgagccgaggggtcaagcgcgagggcgagagcatgtacccgaccatgcagatcatggtgcccaagcgcaggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctacacttctaccgccgccacggctaccgagcctcccaggaggcgaagatggggcgccgccagccggctgatgcccaactacgtggtgcatccttccatcatcccgacgccgggctaccgcggcacccggtactacgccagccgcaggcgcccagccgccaaacgccgccgccgcaccgccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccgcccacggtggtggagatggaagatgcaactcctccgccaccaaggggcgaaaagcgcccgcggcctgacgcggaggagacgatcctgcaggttgacgagccgccatcgtacgaggaggccgtcaaggccggcatgcccaccacgcgcatcatcgcgccgctggccacgggtgtaatgaaacccgccacccttgacctgcctccaccacccacgcccgctccaccgaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctattcgggcacggcttacaacagcctggccccaaaaggtgcccccaactccagtcagtgggagcagaaaaaaactactggtggaggcaatgacatggaaacgcatacttatggcgttgcagccatgggtggagaagacattacagaaaagggccttcaaattggcattgatgaaactaaagaagaaaataacaagatatttgcagacaaaacattccaaccagaacctcaagtgggagaagaaaactggcaggaaacatttgttttttatggcggtagagctcttaagaaggacaccaaaatgaaaccatgctatggctcatttgccagacctactaatgaaaagggaggtcaggctaaatttgtacttgaccaggaaggaaagccaactaaaaatcatgatatcacaatggctttctttgatactcctggtggacaattgaatggaaaagatgagcttaaggcagacattgtcatgtacactgaaaatgtcaacctggaaacacctgacacgcatgttgtttacaaacctggaacttcagatgacagttcagaaatcaatttggttcaacagtccatgccaaatagacccaactacattggcttcagggacaactttgtagggctcatgtattacaacagcactggcaacatgggtgtgctggcaggtcaggcctctcagttgaatgctgtggtggatttgcaagacagaaacacagagctatcttaccagctcttgctagattctctgggtgacagaaccagatactttagcatgtggaactctgcggtggacagctatgatccagatgttaggatcattgagaatcacggtgtggaagatgaacttccaaactattgcttcccattggatggcgctggaactaatgcagtttaccaaggtgtaaaaattacagatggaaatgatggtgatgtcaatgatgactgggaaaaagacaccgcagtatctgaacgtaatcagatatgcaagggcaacatctatgccatggagatcaacctccaggccaacctgtggaagagttttctgtactcgaatgtggccctgtacctgcccgactcctacaagtacacgccggccaacgtcaagctgcccgccaacaccaacacctacgagtacatgaatggccgcgtggtagccccctcgctggtggacgcttacatcaacatcggcgcccggtggtcgctggaccccatggacaatgtcaatcccttcaaccaccaccgcaacgcgggcctgcgctaccgctccatgctgttgggcaacggccgctacgtgcccttccacatccaagtgccccaaaagttctttgccatcaagaacctgctcctgctcccaggctcctacacctacgagtggaacttccgcaaggacgtcaacatgatcttgcagagttctctcggcaacgatctgcgcgtcgacggcgcctccgtccgcttcgacagcgtcaacctctacgccaccttcttccccatggcgcacaacactgcctccaccctggaagccatgctgcgcaacgacaccaacgatcagtccttcaacgactacctctcggccgccaacatgctctaccccatcccggccaaggccaccaacgtgcccatttccatcccctcgcgcaactgggccgccttccgcggctggagtttcacccggctcaagaccaaagaaactccctccctcggttctggtttcgacccatactttgtctactctggctccatcccctatctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgttaccctgcccttccagcacaacaactcgggcttcaccggctacctcgcacccaccatgcgtcaggggcagccctaccccgccaacttcccctacccgctcatcggccagacagccgtgccctccgtcacccagaaaaagttcctctgcgacagggtcatgtggcgcatccccttctccagcaacttcatgtccatgggcgcccttaccgacctgggtcagaacatgctctacgccaactcggcccacgcgctcgacatgaccttcgaggtggaccccatggatgagcccaccctcctctatcttctcttcgaagttttcgacgtggtcagagtgcaccaaccgcaccgcggcgtcatcgaggccgtctacctgcgcacgcccttctccgccggcaacgccaccacataagcatgagcggctccagcgaaagagagctcgcggccatcgtgcgcgacctgggctgcgggccctactttttgggcacccacgacaagcgcttcccgggcttcctcgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactcccattactttcgatcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggaacttgggataccacttgaactcggggatcaccagtttgggcactggggtctcggggaaggtctcgctccacatgcgccggctcatctgcagggcgcccagcatgtccggggcggagatcttgaaatcgcagttgggaccggtgctctgtgcgcgcgagttgcggtacacggggttgcagcactggaacaccatcagactggggtacttcacactggccagcacgctcttgtcgctgatctgatccttgtccaggtcctcggcgttgctcaggccgaacggggtcatcttgcacagctggcggcccaagaagggcacgctctgaggcttgtggttacactcgcagtgcacgggcattagcatcatccccgcgccgcgctgcatattcgggtagagggccttgacaaaggccgagatctgcttgaaagcttgctgggccttggctccctcgctaaaaaacagcccgcagctcttcccgctgaactggttattcccgcacccggcatcctgcacgcagcagcgcgcgtcatggctggtcagttgcaccacgctccgtccccagcggttctgggtcaccttggccttgctgggttgctccttcagcgcgcgctgcccgttctcgctggtcacatccatctccaccacgtggtccttgtggatcatcaccgttccatgcagacacttgagctggccttccacctcggtgcagccgtgatcccacagggcgcagccggtgcactcccagttcttgtgcgcgatcccgctgtggctgaagatgtaaccttgcaacatgcggcccatgatggtgctaaatgctttctgggtggtgaaggtcagttgcagaccgcggacctcctcgttcatccaggtctggcacatcttttggaagatctcggtctgctcgggcatgagcttgtaagcatcgcgcaggccgctgtcgacgcggtagcgttccatcaacacgttcatggcatccatgcccttctcccaagacgagaccagaggcagactcagggggttgcgtacgttcaggacaccgggggtcgcgggctcgacgatgcgttttccgtccttgccttccttcaacagaaccggcggctggctgaatcccactcccacgatcacggcttcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctacgggacgctctggccgaccggagcgaaacccccctcagcgtcgaggagctgtgtcgggcctacgagctcaacctcttctcgccgcgcgtgccccccaaacgccaacccaacggcacctgcgagcccaacccgcgtctcaacttctaccccgtctttgcggtccccgaggcccttgccacctatcacatctttttcaagaaccaaaagatccccgtctcctgccgcgccaaccgcacccgcgccgacgcgctcctagctctgggacccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggcagtgctcaagcgcagcgtcgagctcacccacttcgcctaccccgccgtcaacctcccgcccaaggtcatgcgtcgcatcatggatcagcttatcatgccccacatcgaggccctcgatgaaagtcagaagcagcgccccgaggacacccggcccgtggtcagcgacgagcagcttgcgcgctggctcgggacccgcgacccccaggccctggagcagcggcgcaagctcatgctggccgtggtcctggtcaccctcgagctcgaatgcatgcgccgcttcttcagcgaccccgagaccctgcgcaaggtcgaggagaccctgcactacactttcaggcacggtttcgtcaggcaggcatgcaagatttccaacgtggagctgaccaacctggtctcctgcctggggatcctgcacgagaaccgcctggggcagaccgtgctccactctaccctcaagggcgaggcgcggcgggactatgtccgcgactgcgtctttctctttctctgccacacatggcagtcggccatgggcgtgtggcagcagtgtctcgaggacgagaacctgaaggagctggacaatcttcttgctagaaatcttaaaaagctgtggacgggcttcgacgagcgcaccgtcgcctcggacctggccgagatcgtgttccccgagcgcctgaggcagacactgaaaggcgggctgcccgacttcatgagccagagcatgttgcaaaactaccgcactttcattctcgagcgatcggggatgctgcccgccacctgcaacgctttcccctccgactttgtcccgctgatctaccgcgagtgtcccccgccgctgtggagccactgctatctcttgcagctggccaactacatcgcctaccactcggacgtgatcgaggacgtgagcggcgaggggcttctcgagtgccactgccgctgcaacctgtgctccccgcaccgctctctggtctgcaacccccagctcctaagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgccctcagcacgcggatctcacggcctgcgtcatcacccagggcgcgatcctcgcccaattgcatgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtagatgggatcgagtgaagggcgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcagaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgctttgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcaacgacggtgttgaacttcccaacaacctttccagtggactgagttacgatacacgtagagctaagctcgtcctctactatcctttcatagagggaacctaccagtgcctgagtggaccttgcttccacagttttactttggtgaacgttaccgacagcagcacagccgctccagaaactaaccttccttctgatactaacaaacctcgtttcggaggtgagctaaggcttcccccttctgaggagggggttagcccttacgaagtggtcgggtatttgattttaggggtggtcctgggtgggtgcatagcggtgctagctcagctgccttgctgggtagaaatcaaaatctttatatgctgggtcagacattgtggggaggaactatgaaggggttcttgctgattatcctttccctggtggggggtgtgctgtcatgccacgaacagccacgatgtaacatcaccacaggcaatgagaggagtgtcatatgcacagtagtcatcaaatgcgagcatgaatgccctctcaacatcacattcaaaaaccgtaccatggggaatgcatgggtgggcgactgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggaaaacatggttgggttttctttggcttttgtgatcatggcctgctttatgtcaggtctgcttgtaggggctctagtttggttcctgaagcgcaagcccaggtacggaaatgaggagaaggaaaaattgctataaatctttttcttttcgcagaaccatgaatactttgaccagtgtcgtgctgctctctcttcttgtagctgttagtcagggactatcggaatctaaagttgtacaaataccatacggcagtgattatgttttagtgggaccaagagatccaccagttcaatggtttgggggtggagattttactatgttctgtaatggaagtaaaactcacttgcgtaacataagacacacttgtaatgaacaaaacctgactttactgtcagttggctatggccatagaggtgattactatggttataggcatgataacacagacagagaacattataaggttataatccaagcacctgcgccaaaaaccagaaaacccctttcaaaaataaaatatgttaatgttaccatgggccaaaatctaacactaagcggaccaccaggaacgccagttacatggcttggtgagggacacaaactttgcgaaggcaaaaatgttttctatcgcgaacttaaccacacttgtacagaaaaggaccttatcctattgtttgtaaataggacgcataatggtccttatattggttacaacaaagaaggtacagacagagaacaatatgaagtgtcagtattagatttaatgccaattgcaggacaaggtttggattcaaaaataaaaaaagaacagaaaagccttcctaaaagaaagccaaaagataaagtaaaagaggttaactttccaacaggatctaatcagacactgattggacctcctggacaaaaaattgattggcatgtgagcagtaatgatggacagtttaaaaaactgtgtgaaactaaagatggaaaacattcttgccatgggcagaacataacaattttaaacattagcagatcagatgaagggtcttactatggttccagtaatgacgcttcaacgcactataagcttactgtgtatgacaaatcaagctttggtaaaccgaaaatcaagattgatccatacaccacaaagggaacaaccactgaaaatcatcatgagtttgaattacaacagggaaatgatcaaacagaagaatcaaaaattccatctactactgtggcaatcgtggtgggagtgattgcgggattcataactataatcattgtgattctgtgctacatctgctgccgcaagcgtcccaggacttacaatcatatggtagacccactactcagcttctcttactgagactcagtcactttcatttcagaaccatgaaggctttcacagcttgcgttctgattagcataatcacacttagtttagcagcacctaaaccagaagtatatacacaagttaatgtcactaggggtgggaatgctacactagatggaccatttaacaataacacatggacaagatatcatgacgatgggaaaaaaagcggatggatgaatatttgtaaatggtcagacccatcatacacatgtcatagtaatggaagccttagtatttttgctttcaacattagttcaggtaaatataaagttcaaagttacactaacagttataatggattagatggttatgaaaaacttgaagttaaaatgtttaatctaacagtaattgagcctccaaccactagagcacccaccacagttaggacaactaaggacacaacacagcctaccactgcacccactacacatccaaccaccacagccagtacaactattgaaaccactactcaaactacagtgcagaatactactttattgattgggtttttactgagaggaaatgaaagtactactgatcagacagaggctacctcaagtgccttcagcagcactgcaaatttaacttcgcttgcttggactaatgaaaccggagtatcattgatgcatggccagccttactcaggtttggatattcaaattacttttctggttgtttgtgggatctttattcttgtggttcttctgtactttgtctgctgcaaagccagagaaaaatctaggaggcccatctacaggccagtaatcggggatcctcagcctctccaagtggaagggggtctaaggaatcttctcttctctttttcagtatggtgattcagccatgattcctaggttcttcctatttaacatcctcttctgtctattcaacgtgtgcgctgccttcgcggccgtctcgcacgcctcgcccgactgtctcgggcccttccccacctacctcctctttgccctgctaacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatttgaccatgcagactctgctcatactgctatccctcctctcccctgccctcgctgatgatgattactctaagtgcaaatttgtggagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcctccacgccaccacccacacctcctccccgcagaaatcagtttcccctgattcagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccaacggcaaacagcatcgcctcacctatgagatgccccagcagaagcagaagttcacctgcatggtgggcgtcaaccccatagtcatcacccagcagtcgggcgagaccagcggctgcatccactgctcctgcgaaagccctgagtgcatctactccctcctcaagaccctttgcggactccgcgacctcctccccatgaactgatgttgattaaaagcccagaaaccaatcagtcccttcccccatttacccatttccccaattctcataaatcattggaattaatcattcaataaagatcacttacttgaaatctgaaagtatgtctctggtgtagttgtttagcagcacctcggtaccctcctcccagctctggtactccagtccccggcgggcggcaaacttcctccacaccttgaaagggatgtcaaattcctggtccacaattttcattgtcttccctctcagatgtcaaagaggctccgggtggaagatgacttcaaccccgtctacccctatgactacgcgcggaatcagaatatccccttcctcactcccccctttgtctcctccgatggattcaaaaacttcccccctggtgtcctgtcactcaaactggctgacccaatcaccatcactaatggggatgtctcgctcaaggtgggagggggactcgccttgcaagaaggaagtggacagctaacagtcaatactaaagctccattgcaagttgcaaatgataaattagaattagcacttgatgctccatttcaagaaaaaaatggaaaactggtattgaaaacaggacatggtttagctgttttaactaaagataacacccacataccagacttaattggaacccttgtagtagtaactggaaatggaattggtacaggtagtgtagctggcggaggaaccatagatgtaagacttggagatgatggtggactctcatttgataaaaagggtgatttagtagcctggaataaaaaagatgacaggcgcactttatggacaacgccagatccatcgccaaattgtagaattgaagttgcaaaggatgcaaaacttactcttgtcttaacaaagtgcggaagtcagattttagcttctgtttcaattattgtactaaaaggaacgtatgaatatgcaaagaaggagacaagcgttaaagagttcagtattaagttactgtttgataaaaatggagtgcttttgcctgaatctaatttggataaagattattggaactacagaagtgatgatttaactatagccaagccatatgaaaatgcagtacctttcatgccaaatttaaaggcatacccaaaacctgatacaactactcaaacaactccaggagataaaaaaagcagtggtaaaaataaaattgtgagtaatgtgtattttggaggtgaggtttatcagccaggagttatagttgttgcttttaatcaagaaaaggaagcaaactgtgcttactccataactttgaaatttggatggggaaagacatatgaaacacccataccatttgatacctcttctttcaccttctcttacattgctcaagaaaatgaagacaaagaacaataaagtgttttgaactgaatttatgtatctttattgatttttacaccagcacgggtagtcagcctcccaccaccagcccatttcacagtgtaaacaattctctcagcacgggtggccttaaataggggaatgttctgattagcacgggaactggatttagtgtctataatccacacagtttcctggcgagccaaacgggggtcggtgattgagatgaagccgtcctctgaaaagtcatccaagcgggcctcgcagtccaaggtcacagtctggtggaacgagaagaacgcacagattcatactcggaaaacaggatgggtctgtgcctttccatcagcgccctcaacagtctctgccgtcggggctcggtgcggctgctgcagatgggatcgggatcgcaagtctctctgactatgatccccacagccttcagcatcagtctcctggtgcgtcgggcacagcaccgcatcctgatctctgccatgttctcacagtaagtgcagcacataatcaccatgttattcagcagcccataattcagggtgctccagccaaagctcatgttggggatgatggaaccaacgtgaccatcgtaccagatgcggcagtatatcaggtgcctgcccctcatgaacacactgcccatatacatgatctctttgggcatatctctgttcacaatctgacggtaccaggggaagcgctggttgaacatgcacccgtaaatgactctcctgaaccacacggccagcagggcgcctccagcccgacactgcagggagc

SEQ ID NO: 1445 - DNA, 32767 bp, Human mastadenovirus D
catcatcaataatataccccacaaagtaaacaaaagttaatatgcaaatgagcttttgaatttagggcgtggccaacgctgattggccgttgcaacgaccgttagtgacgtcacgacgcacggcgtcaacggtcggcgcggaggcgtggcctaggccggaagcaagtcgcgggtctgatgacgtctaaaaaagcggactttagacccggaaatggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacctggtcagctgatccacagggtatttaaaccagtcgagaccgtcaagaggccactcttgagtgccagcgagtagagatttctctgagctccgctcccagagtctgagaaaaatgagacacctgcgcctcctgccagcaactgtgcctatggacatggctgtgcttctgctggacgactttgtgaatacagtattggaggacgaactgcatccaagtccgttcgagctgggacccacacttcaggacctctatgatctggaggtagatgcccatgaggacgacccgaacgaagaggctgtgaatttaatatttccagaatctatgattcttcaggctgacatagccaacgaatctattcctactccacttcatactccaactctgtcacccatacctgaattggaagaggaggacgagttagacctccggtgctacgaggaaggttttcctcccagcgattcagaggacgaacagggtgagcagagcatggctctaatctcagactatgcttgtgtggttgtggaagagcattttgtgttggacaatcctgaggtgcccggggaaggctgtagatcctgccaatatcaccgggatcagaccggagaccctaatgcctcctgcgctctgtgttacatgaaaaccactttcagctttatttacagtaagtggagtgaatgtgagagaggctgagtgcttaacacatctctgtgtgatgcttgaacagctgtgctaagtgtggtttatttttgttactaggtccggtgtcagaggatgagtcatcaccctcagaagaagaccacccgtcaccccctgatctcacagatgacacgctcctgcaagtgtacagacccaccccagtcagacccagtggcgagaggcgagcagctgttgacaaaattgaggacttgttgcaggacatgggtggggatgaacctttggacctgagcttgaaacgccccaggaactaggcgcagctgcgctgagtcatgtgtaaataaagctgtataataaaagtatatgtgacgcatgcaaggtgtggtttatgactcatgggcggggcttagacctatataagtggcaacacctggacactcagacacagaccttcagggagctcctgatggaggtgtggactatccttgcagactttaacaagacacgccggcttgtagaggatagttcagacgggtgctccgggttctggagacactggtttggaactcctctatctcgcctggtgtacacagttaagaaggattatagcgaggaatttgaaaatcttttttccgactgctctggcctgcttgattcactgaattttggccaccagtcccttttccaggaaagggtcctccacagccttgatttttccagcccagggcgcactacagccggggttgcttttgtggtttttctggttgacaaatggagccagaacacccaactgagcaggggctacatcctggacttcgcggccatgcacctgtggagggcctggatcaggcagcggggacagagaatcttgaactactggcttctacagccagcagctccgggtcttcttcatctacacagacaaacatccatgttggaggaagaaatgagggaggccatggacgacaacccgaggagcggcctggaccctccgtcggaagaggagctggattgaatcaggtatccagcctgtacccagagcttagcagggtgctgacatccatggccaggggagtgaagcgggagaggagcgatgggggcaataccgggatgatgaccgagctgacggccagcctgatgaatcgcaagcgcccagagcgcattacctggcatgagctacagctggagtgcagggatgaggtcggcctgatgcaggataaatatggcctggagcagataaaaacccactggttgaacccagatgaggattgggaggaggccattaagaagtatgccaagattgccctgcgcccagattgcaagtacagggtgaccaagacggtgaatatcagacatgcctgctacatctcagggaacggggcagaggtggtcatcgataccctggacaaggccgccttcaggtgttgcatgatgggaatgagagccggagtgatgaatatgaattccatgatcttcatgaacatgaagttcaatggagagaagtttaatggggtgctgttcatggccaacagccacatgaccctgcatggctgtgatttcttcggcttcaacaatatgtgtgcagaggtctggggcgccgctaagatcaggggatgtaagttttatggctgttggatgggcgtggtcggaagacccaagagcgagatgtctgtgaagcagtgtgtgtttgagaaatgctacctgggagtctctaccgagggcaatgctcgagtgagacactgctcttccatggagacgggctgcttctgcctggtgaagggcacagcctcgatcaagcataatatggtgaagggctgcacggatgagcgcatgtacaacatgctgacctgcgactcgggggtctgccatatcctgaagaacatccatgtgacctcccaccccaggaagaagtggccagtgtttgagaataacctgctgatcaagtgccatatgcacctgggtgtcagaaggggtaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcaaccggtggccctggatgtgaccgaggatctgcgacccgaccacctggtgatggcctgtaccgggaccgagttcagctccagtggggaggacacagattagaggtaggtttgagtagtgggcgtggctaaggcgactataaaggtgggtgtcttacgagggtctttttgcttttctgcagacatcatgaacgggaccggcgggcacttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggacgagctcgtcgctcgacagcaccgccgcagccgcggcagccgcagccgccatgacagcgacgagactggcctcgagctacatgccaagcagcaacagcagcccctccgtccccagttccatcatcgccgatgagaaactgctggccctgctggcagagctggaagccctgagccgccagttggccgccctgacccagcaggtgtccgatctccgcgagcaacagcagcagcaaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtggagtttggcctggatcttgaggttggcgatgttgccgcccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggacccggggcgaagttcccctcgcagatctgcatctcccaggctttcatctcggagggggggatcatgtccacctgcggggcgatgaaaaaaacggtttccggggcgggggtgatgagctgcgaggatagcaggtttctcaacagctgggacttgccgcacccggtcgggccgtagatgaccccgatgacgggttgcaggtggtagttcaaggagatgcagctgccgtcgtcccggaggaggggggccacctcgttgagcatgtccctgacttggaggttttcccggacgagctcgccaaggaggcggtccccgcccagcgagagcagctcttgcagggaagcaaagtttttcaggggcttgagcccgtcggccatgggcatcttggcgagggtctgcgagaggagctcgaggcggtcccagagctcggtgacgtgctctacggcatctcgatccagcagacttcctcgtttcgggggttgggacgactgcgactgtagggcacgagacgatgggcgtccagcgctgccagcgtcatgtccttccagggtctcagggtccgcgtgagcgtggtctccgtcacggtgaatgggtgggccccgggctgggcgcttgcaagggtgcgcttgagactcatcctgctggtgctgaaacgggcacggtcttcgccctgcgcgtcggcgagatagcagttgaccatgagctcgtagttgagtgcctcggcggcgtggcccttggcgcggagcttgcccttggaagagcgcccgcaggcgggacagaggagggattgcagggcgtagagcttgggtgcaagaaagacggactcgggggcaaaggcgtccgctccgcagtgggcgcagacggtctcgcactccacgagccaggtgagctcgggccgctcggggtcaaaaaccagttttcccccgttctttttgatgcgcttcttacctcgcgtctccatgagtctgtgtccgcgttcggtgacaaacaagctgtctgtgtccccgtagacggacttgatgggcctgtcctgcaagggcgtcccgcggtcctcctcgtagagaaactcggaccactctgagacaaaggcgcgcgtccacgccaagacaaaggaggccacgtgcgaggggtagcggtcgttgtccaccagggggtccaccttttccacggtatgcagacacatgtccccctcctccgcatccaggaaggtgattggcttgtaggtgtaggccacgtgacccggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcgatgcttttgagtagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatactcgcgcgcgacacacttccattcggggaagacggtggtgcgctcgtcgggcacgatcctgacgcgccagccgcggttatgcagggtgaccaggtccacactggtggccacctcgccgcgcaggggctcgttggtccagcagagtcgcccgcccttgcgcgagcagaaagggggcagcacatccaagaggtgctcgtcaggggggtccgcatcgatggtgaagatgcccggacagagttccttgtcaaaatagtctatttttgaggatgcatcatccaaggccatctgccactcgcgggcggccattgctcgctcgtaggggttgaggggcggaccccatggcatgggatgcgtgagcgcggaggcgtacatgccgcagatgtcgtagacatagatgggctccgcgaggatgccgatgtaggtgggataacagcgccccccgcggatgctggcgcgcacatagtcatacaactcatgcgacggggccaaaaaggcggggccgagattggtgcgctggggctgctcggcgcggaagacgatctggcgaaagatggcatgcgagtttgaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgtctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgtgcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccggcacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggctagatcgcgagcgagggcgaccagctcggggtcccccgagaatttcatgaccagcatgaaggggacgagctgcttgccgaaggaccccatccaggtgtaggtttctacatcgtaggtgacaaagagccgttccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgtcgcctctgcgtgaagaccactggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctcgacggtggcggcgaggtcgttggagatgcggcccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcgtagttgcgcaggcgctggaagaggtagttgagggtggtggcgatgtgctcggtgacgaagaagtacatgatccagcggcgcaggggcatctcgctgatgtcgcccatggcctctagcctttccatggcctcgtagaaatccacggcgaagttgaaaaactgggcgttgcgggccgagaccgtgagctcgtcttccaggagccggatgagctcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtaatcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgagcgaccagttaacggtctgcaggccgggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtatccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgctggccgcggggagtcgctatgcttgaaagcggccgaaaaccccgccgggtagtggctcgcgcccgtagtctggagaagcatcgccagggttgagtcgcggcagaacccggttcgcggacggccgcggcgagcgggacttggtcaccccgccgattaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcatgtggcggcggccaacctggtgacggcctacgagcagacggtgaagcaggagcgcaacttccaaaagagtttcaacaaccatgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggccgctggctgctggagctgatcaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcgcgagccggcggcgcgagctaagcgaccgcgagctgatgctgagcctgcgccgggcgctggtaggcggcgccgccggcggcgaggagtcctacttcgacatgggggcggacctgcattggcagccgagccggcgcgccttggaggccgcctacggtccagaggacttggatgaggaagaggaagaggaggaggatgcacccgttgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactttcggccattctggaggcggtggtcccctctcggaccaaccccacgcacgagaaggtgctggcgatcgtgaacgcgctggcggagaacaaggccattcgtcccgacgaggctgggctggtatacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattataccaactttatcagcgcgctgcggctgatggtgaccgaggttccccagagcgaggtgtaccagtcgggtccggactactttttccagactagccggcagggcctgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagtgtgaaccgcaactcgtacctgggtcacctgctgacgctgtaccgcgaggccataggccaggcacaggtggacgagcagaccttccaggagatcactagtgtaagccgcgcgctggggcggaacgacaccgacagtctgagggccaccttgaacttcttgctgaccaatagacagcagaagatcccggcgcagtatgcgctgtcggccgaggaggagcgcatcctgagatatgtgcagcagagcgtagggctgttcctgatgcaggagggggccacacccagcgccgcgctggacatgaccgcgcgcaacatggaacctagcatgtacgccgccaaccggccgttcatcaataagctgatggactacctgcaccgcgcggcgtccatgaactcggactactttaccaatgccattttgaacccgcactggctcccgccgccggggttctacacgggcgagtacgacatgcccgaccccaacgacgggttcctgtgggacgacgtggacagcgcggtgttctcaccgaccttgcaaaagcgccaggaggcggtgcgcacgcccgcgagcgagggtgcggtgggtcggagcccctttcctagcttagggagtttgcatagcttgccgggctcggtgaacagcggcagggtgagccgcccgcgcttgctgggcgaggacgagtacctgaacgactcgctgctgcagccgccgcgggtcaagaacgccatggccaataacgggatagaaagtctggtggacaaactgaaccgctggaagacctacgctcaggaccatagggagcctgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctagaaagcatcccaaagatgtgccagttaatgatttaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgcctggctgcggggtggacttcaccgagagccgcctgagcaacctcctgggcattcgcaagaagcaacctttccaagagggcttcagaatcatgtatgaggatctcgaagggggcaacatccccgcacttctgaatgtgaccaagtacctggaaagcaagaagaagctagaggaggcagtggagaatgccgctaaggctaatggtcctgcaagaggagacagtagtgtctcaagagaggtggaaaaggcagctgaaaaagagcttgtcattgagcccatcaagcaagatgatagcaagagaagttacaacctcatcgagggtacccatgacaccctgtaccgaagctggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggttggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgtgtgctttccagtcgcaccttctaaaaaatgtctattctcatctcgcccagcaataacaccggctggggtattactaggcccagcgccatgtacggaggagccaagaagcgctccctgcagcaccccgtccgcgtccgcggccacttccgcgctccctggggcgcttacaagcgcgggcggactgccaccgccgccgccgtgcgcaccaccgttgacgacgtcatcgactcggtggtcgccgacgcgcgcaactatacccccgccccctccaccgtggacgcggtcatcgacagcgtggtggccgacgcacgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgctactgcaccccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctccctcgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagaacatgtacccgaccatgcagatcatggtgcccaagcgccggcgcgtggaggaagtgctggacagcgtgaaaatggatgtggagcccgaggtcaaggtgcgccccatcaagcaggtggcgccgggcctgggcgtacagaccgtggacattcagatccccaccgacatggatgtcgacaaaaaaccctcgaccagcatcgaggtgcagaccgacccctggcttccagcctccacctctaccgcctctacttctaccgccgccacggctaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtaaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgtggcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggaactatgggaacaaggcctggaatagtagcacggggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccgtccacggtggtggagatggaagatgcaactccgcccaagggcgagaagcggccgcggcccgacgcggaggagacgatcctgcaggtggatgagcctccctcgtacgaggaggccgtcaaggccggcatgcccaccacgcgcatcatcgcgccgctggccacgggtgtaatgaaacccgccacccttgatctgcctccaccacccacgcccgctccaccgaaggcagctccggttgtgcaggcccccccggtggcgaccgccgtgcgccgcgtccccgcccgccgccaggcccagaactggcagagcacactgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagtccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggcccccaagggtgcccctaattccagtcagtgggaagaaaaaaagaatggagctggaaatcaaaccgaaactcatacgtatggcgtcgctcccatgggcggaactaacattacaattaatggtttgcaaattggaactgaggaagaagatggaaatcctacaaaggaaatttttgcagataaaacattccagcctgaacctcaaataggagaagaaaactggcaggacactgagaatttttatggcggcagagctcttaagaaagacaccaaaatgaaaccttgctatggctcttttgccagacctactaacgaaaagggaggtcaagctaagttaaaacttgacgcccaaggtcagccaactaaagattatgacattgacctggctttctttgactcacctggaggaaacacagcaactggtggtcaagaagagcttaaagcagacattgtcatgtacactgagaatgcttatctggaaacaccagatacccatgtagtttacaagccaggaacttctgatgacagttctgccgccaacttggttcagcagtccatgcccaacaggccaaactacatcggcttcagagacaactttgtgggtctcatgtattataacagcactggcaacatgggtgtgctggctggtcaggcctctcagttgaatgccgtggttgacttgcaagacagaaacacagagctgtcttaccagctcttgctagattctctgggtgacagaaccagatactttagcatgtggaactctgcggtggacagttacgatcccgatgtcaggatcattgagaatcatggcgtggaagatgaacttccaaactattgcttcccattggacggctctggcaccaatgcagcttatcaaggtgttaaagttaaaaatggggaagatggtgatattgagagcgaatgggaaaaagacaccaatgtcgcagctcgtaaccaactgtgcaagggcaacatcttcgccatggagatcaacctccaggccaacctgtggaagagttttctgtactcgaacgtggccctgtacctgcccgactcctacaagtacacgccggccaacgtcaagctgcccaccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgcttctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaggaaactccatccctcggctcgggtttcgacccctactttgtctactcgggctccatcccctatctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggtttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggtttcaccggctacctcgcacccaccatgcgtcaggggcagccctaccccgccaacttcccctacccgctcatcggccagacagccgtgccctccgtcacccagaaaaagttcctctgcgacagggtcatgtggcgcatccccttctccagcaacttcatgtccatgggcgcccttaccgacctgggtcagaacatgctctacgccaactcggcccacgcgctcgacatgaccttcgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaagcatgagcggctccagcgaaagagagctcgcggccatcgtgcgcgacctgggctgtgggccctactttttgggcacccacgacaagcgtttccctggcttcctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagtctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctacccaccctccggcgcaaccaggaggagctctaccgcttcctcgcgcgccactccccttactttcgctcccaccgcgccgccatcgaacacgccaccgcttttgataaaatgaaacaactgcgtgtatgactcaaataaacagcacttttattttacatgcactggagtatatgcaagttatttaaaagtcgaaggggttctcgcgctcgtcgttgtgcgccgcgctggggagggccacgttgcggtactggtacttgggataccacttgaactcgggaatcaccagtttgggcactggggtctcggggaaggtctcgctccacatgcgccggctcatctgcagggcgcccagcatgtcaggcgcggagatcttgaaatcgcagttgggaccggtgctctgtgcgcgcgagttgcggtacacagggttgcagcactggaacaccatcagactggggtacttcacactggccagcacgctcttgtcgctgatctgatccttgtccagatcctcggcgttgctcaggccgaacggggtcatcttgcacagctggcggcccaggaagggcacgctctgaggcttgtggttacactcgcagtgcacgggcatcagcatcatccccgcgccgcgctgcatattagggtagagggccttgacaaaggccgcgatctgcttgaaagcttgctgggccttggccccctcgctgaaaaacagcccacagctcttcccgctgaactggttattcccgcacccggcatcatgcacgcagcagcgcgcgtcatggctggtcagttgcaccacgcttcggccccagcggttctgggtcaccttagccttgctgggctgctccttcaacgcgcgctgaccgttctcgctggtcacatccatctccaccacgtggtccttgtggatcatcaccgtcccatgcagacacttgagctggccttccacctcggtgcagccgtggtcccacagggcgcagccggtgcactcccagttcttgtgcgcgatcccgctgtggctgaagatgtaaccttgcaacatgcggcccatgatggtgctaaatgctttctgggtggtgaaggtcagttgcatcccgcgggcctcctcgttcatccaggtctggcacatcttttggaagatctcggtctgctcgggcatgagcttgtaagcatcgcgcaggccgctgtcgacgcggtagcgttccatcagcacgttcatggcatccatgcccttctcccaggacgagaccagcggcagactcagagggttgcgcacgttcaggacaccaggggtcgcgggctcgacgatgcgttttccgtccttgccttccttcaacagaaccggcggctggctgaatcccactcccacgatcacggcatcttcctggggcatctcttcgtcggggtctaccttggtcacatgcttggtcttcctggcttgcttcttttttggagggctgtccacggggaccacgtcctcctcggaagacccggagcccacccgctgatactttcggcgcttggtgggcagaggaggtggtggcggcgaggggctcctctcctgctccggcggatagcgcgccgacccgtgaccccggggcggagtggcctctcggtccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccatcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccgtctcctgtcgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgttgagctcacccacttcgcctaccccgccgtcaacctcccgcccaaggtcatgcgtcgcatcatggatcagctcatcatgccccacatcgaggccctcgatgagacccaagagcagcgcccagaggacgcccggcccgtggtcagcgacgagcagctcgcgcgctggctcgggacccgcgacccccagaccctggagcagcggcgcaagctgatgctggccgtggtcctggtcaccctcgagctcgaatgcatgcgccgcttcttcagcgaccccgagaccctgcgcaaggtcgaggagaccctgcactacactttcaggcacggcttcgtcaggcaggcctgcaagatctccaacgtggagctgaccaacctggtctcctgcctggggatcctgcatgagaaccgccttgggcagaccgtgctccactctaccctgaagggcgaggcgcggcgggactatgtccgcgactgcgtctttctctttctctgccacacatggcaagcagccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccctgagcgccttaggcagacgctgaaaggcgggctgcccgacttcatgagccaaagcatgttgcaaaactaccgcactttcattctcgaacgatcggggatcctgcccgccacctgcaacgccttcccctccgactttgtcccgcttagctaccgcgagtgtcccccgccgctgtggagccactgctacctcttgcagttggctaactacatcgcccaccactcggatgtgatcgaggacgtgagcggcgaggggctgctagagtgccactgccgctgcaacctgtgctccccgcaccgctccctgatctgcaacccccagctactcagcgagacccaggtcatcggtaccttcgagctgcaaggtccggagaagtccaccgctccgctgaaactcacgccggggttgtggacttccgcgtacctgcgcaaatttgtacccgctgactaccacgcccatgagataaagttcttcgaggaccaatcgcgtccgcagcatgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctgaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcaggcgcctcccaggactactccacccgcatgaactggctcagtgccggcccctcgatgatctcacaggtcaacggggtccgtaaccatcgaaaccagatattgttggagcaggcggcggtcacctccacgcccagggcaaagctcaacccgcgtaattggccctccaccctggtgtatcaggaaatccccgggccaactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgatgcagtgagagaagcggtggacggctacgactgaatgtccaatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgttgtactctgtgtgctgagtttaataaaagctaaactcctacaatactctgggatcccgtgtcgtcgcactcgcaacgagatcttcaacctcaccaaccagactgaggtaaaactcaactgcagaccagggggcaaatacatcctctggctctttgaaaacacttccttcgcagtctccaacgcctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcgcagccgctccagaaacatctaacctttttgatactaacactcctaaaaccggaggtgagctctgggttccctctttaacagaggggggtaaacatattgaagcggttgggtatttgattttaggggtggtcctgggtgggtgcatagcggtgctgtattaccttccttgctggatcgaaatcaaaatctttatctgctgggtcatacattgttgggaggaaccatgaaggggctcttgctgattatccttttcctggttgggggtgtactgtcatgccacgaacagccacgatgtaacatcaccacaggcaatgagaggagtgtgatatgcacagtagtcatcaaatgcgagcatacatgtcctctcaacatcacattcaagaataagaccatgggaaattcatgggtgggcgattgggaaccaggagatgagcagaactacacggtcactgtccatggtagcgatgggaatcacactttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctttagtatggttcctgaagcgcaagcctaggtatggaaatgaggagaaggaaaaattgctataaatctttttcttttcacagcaccatgaatactttgaccagtgtcgtgctgctctctcttcttgtagcttttagtcaggcaggaattattaacttaaatgtatcatggggaatgaatctaactttagtgggaccatcagacctgccagttacatggtatgatggaaagggaatgcagttttgtgatggaaatacaattaagaacccacaaatcaagcatagctgtaatcaacagaatctaactttacttaatgctgacaagtctcatgaaagaacttacctaggttacagacatgacagtaagggaaaagtagactataaggttacagtcataccacctcctccagccactcgcaagcctttgtcagagcctcattatgttactgtgactatgggcgataacataactttagtgggaccctcagacctgccagttacatggtatgatggagaaggaaataaattctgcgatggagaaaaagttgaacatgcagaatttaatcatacatgtaacatccagaacctgacactgctctttgtcaacttaacgcataatggagcatacattggttataacaaagacggttctgatagagaattatatgaggtgtcagtcaaaaccttgtttcagaacggggctggacaaggtaataaagggaaacctaatactgctcaaagtggtggtaaaaaaaccaaaacagaacatagaaaccagagtccaaaaagaaaatcaacaaataaccttcagccaacacaattgtatgttaggccttttactaatgttagtttaactggacctccaaatggcaaggttacttggtatgatggcgaacttaatgatccatgtgaacaaaagtacaaactcagaactttttgcaatcagcaaaatctaactttaattaatgtaagcagcacttatgatggcatctattatggcactgatgaaaaagataaggcaaatcgttacagaataaaagtaaatactacaaatcacaaaactgttaaaattaagccacataccagagaacctcctgctgtacaagaaaaacagtttgaattacaagatgcagaaactgatgaaaacgaatcaaaaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaagctcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttactgcatataaatgcttcaataatggaagcattactattactgccactgccaacattacttctggcacatacaaagctgaaagctataaaaatgaaatcaaaaaactaacctataaaaacaacaaaaccacatttgaagattctggaaattatgaacatcaaaaattatctttttatatgttgacaataattgaactgcctacaactaaggctcccaccacagttaggacaactattaagaccactactcacactacagtgcaaaatactactttattgattgggtttttactgagagagaatgaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagagaaatctaggaggcccatctacaggccagtgattggggaacctcagccactccaagtggatggaggcttaaggaatcttctcttctcttttacagtatggtgatcagccatgattcctaggttcttcctatttaacatcctcttttgtctcttcaacatctgtgctgccttcgcggccgtctcgcacgcctcgcccgactgtctagggcctttccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggaatttcttagattgctatcaggagaaaattgatatgccctcctattacttggtgtttgtgggaatagtcatggtctgctcctgcactttctttgccatcataatctacccctgttttgatctcggctggaactctgttgaggcattcacatacacactagaaagcagttcactagcctccacgccaccgcccacaccgcctccccgcagaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgccttgtcaaacaggcaaagatcacctacgagctcgtgtccggcggcaagcagcatcgcctcacctatgagctgccccagcagaagcagaagttcacctgcatggtgggcgtcaaccccatagtcatcacccagcagtcgggcgagaccagcggctgcatccactgctcctgcgaaagccccgagtgcatatactccctcctcaagaccctttgcggactccgcgacctcctccccatgaactgatgttgattaaaagcccgaaaaccaatcagacccttcccccatttccccattcccaattactcataaaataaatcattggaattaatcattcaataaaaatcacttacttgaaatctgaaagtatgtctctggtgtagttgttcaacagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactagctgacccaatagccatcgtcaatgggaatgtctcactcaaagtgggagggggtctcactttgcaagatggaactggaaaactaacagtcaatgctgatccacctttgcaacttacaaacaacaaattagggattgctttggacgctccatttgatgttatagataataaactcacattgttagcgggccatggcttgtctattataacaaaagaaacatcaacactgcctggcttgattaatactcttgtagtattaactggaaagggtattggaacagaatcaacagataatggcggaagcgtatgtgttagagttggagaaggtggcggcttatcatttaataatgatggagacttggtagcatttaataaaaaagaagataagcgcaccctatggacaactccagacacatctccaaattgcaagattgatcaggataaggactctaagttaactctggtccttacaaagtgtggaagtcaaatattggctaatgtgtcattaattgtcgtagctggtaagtacaaaattatcaataacaatactcaaccagctctcaaaggatttaccattaaattattgtttgatgaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtagatgttgaatttgaaacaacctcttttaccttttcctatatcgcccaagaatgaaagaccaataaacgtgtttttcatttcaaaattttcatgtatctttattgatttttacaccagcacgggtagtcagtctcccaccaccagcccatttcacaatgtacacggtcctttcagcacgggtggccttaaataggggaatgtcctgattagtgcgggaactggttttagtgtctataatccacacagtttcctggcgagccaaacgggggtcggtgattgagatgaagccgtcctctggaaagtcatccaagcgggcctcacagtccaaggtcacagtctggtggaatgagaagaacgcacagattcatactcggaaaacaggataggtctgtgcctctccatcagcgccctcaacagtctctgccgccggggctcggtgcgactgctgcagatgggatcgggatcgcaagtctctttgactatgatccccacagccttcagcaacagtctcctggtgcgacgggcacagcaccgcatcctgatctcactcaagttctcacagtaagtgcagcacataatcaccatgttattcagcagcccataattcagggcgctccagccaaagctcatgttggggataatggaacccacgtgaccatcgtaccagatgcggcagtatatcaggtgcctgcccctcatgaacacactgcccatatacatgatctctttgggcatgtctctgttcacaatctgacggtaccaggggaagcgctggttgaacatgcacccgtaaatgactctcctgaaccacacggccagcag

SEQ ID NO: 1446 - DNA, 32767 bp, Human adenovirus 58
catcatcaataatataccccacaaagtttacaaaagttaatatgcaaatgagcttttgaattttaacggttttggggcggagccaacgctgattggacgagaagcggtgatgcaaatgacgtcacgacgcacggccgacggtcgccgcggaggcgtggcctagcccggaagcaagtcgcggagctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagtgaaaaataccggtcccgcccagggtggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtctgagaaaaatgagacacctgcgcctcctgcctggaactgtgcctatggacatggctgtgcttttactggatgactttgtgaatacagtattggaggacgaactgcatccaagtccgttcgagctgggacccacacttcaggacctttatgatctggaggtagatgcccatgatgacgacccgaacgaagaggctgtgaatttaatatttccagaatctatgattcttcaggctgacatagccaacgaatctatacctactccacttcatacaccgactttaccacccatacctgaattggaagaggaggacgaactagacctccggtgttatgaggaaggttttcctcccagcgattcagaggacgaacggggtgagcagagtatggctataatatcagactatgcttgtgtggttgtggaagagcattttgtgttggacaatcctgaggtgccagggcaaggctgtagatcctgccaatatcaccgggatcagaccggagacccaaatgtttcctgcgctctgtgttacatgaaaatgagcttcagctttatttacagtaagtggagtgaatgtgagagaggctgagtgcttaacacataactgtaatgcttgaacagctgcgctaagtgtggtttatttttgttactaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactaggcgcagctgcgcttagtcatgtgtaaataaagttgtacaataaaagtatatgtgacgcatgcaaggtgtggtttgactcatgggctgggcttagtcctatataagtggcaacacctgggcactcgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatctttttgctgactgctctggtctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgttggaagaggagctggattgaatcaggtatccagcctgtacccagagcttagcaaggtgctgacaaccatggccaggggagtgaagagggagaggagtgatgggggcaataccgggatgatgaccgagctgactgccagcctgatgaatcggaagcgcccagagcgccttacctggtacgagctacagcaggagtgcagggatgagataggcctgatgcaggataaatatggcctggagcagataaaaactcactggttgaacccagatgaggattgggaggaggccataaagaaatatgccaagatagccctgcgcccagattgcaagtacatagtgaccaagacggtgaatatcagacatgcctgctacatctcagggaacggggcagaggtggtcatcgataccctggacaagtcagcattcaggtgttgcatgatgggaatgagagccggagtgatgaatatgaattccatgatcttcatgaacatgaagttcaatggagagaagtttaatggggtgctgttcatggccaacagccacatgaccctgcatggttgcagcttcttcggtttcaacaacatgtgcgccgaggtctggggagctgctaagatcaggggctgtaagttttatggctgctggatgggcgtggtcggaagacccaagagcgagatgtctgtgaagcagtgtgtgtttgagaagtgctacctgggggtgtctacagagggcaatgctagagtgagacattgctcttccctggagacgggctgcttctgcctggtgaagggcacagcttcgatcaagcataatgtggtgaaaggctgcacggatgagcgcatgtacaacatgctgacctgcgactcaggggtctgttatatcctgaagaacatccatgtgaccgcccaccccagaaagaagtggccagtgtttgagaataacctgctaatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgaaaccaggtccagggtgcgcgcttgcgagtgcgggggcagacacaccaggatgcagcctgtggccctggatgtgacagaggagctgagaccagaccacctggtgatggcctgtaccgggaccgagttcagctccagtggggaggacacagattagaggtaggtttgagtagtgggcgtggctaatgtgactataaaggtgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgcccagtgcttccagcaaattcctcgaccatgacctacgcgaccgtggggacgagctcgtcgctcgacagcaccgccgcagccgcggcagccgcagccgccatgacagcgacgagactggcctcgagctacatgcccagcagcggtagcagcccctctgtgcccagttccatcatcgccgaggagaaactgctggccctgctggccgagctagaagccctgagccgccagctggccgccctgacccagcaggtgtccgatctccgcgagcaacagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcgatgttgccgcccagatcccgcctggggttcatgttgtgcaggaccaccaggacggtgtagcccgtgcacttggggaacttatcatgcaacttggaagggaatgcgtggaagaatttggagacgcccttgtgcccgcccaggttttccatgcactcatccatgatgatggcaatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcaaagttcccctcacagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccgagaaggcggtccccgcccagcgagaggagctcttgcagggaagcaaagtttttcaggggcttgagtccgtcggccatgggcatcttggcgagggtctgcgagaggagttcgagacggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagtgtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccacaggcgggacagaggagggattgcagggcgtagagcttgggcgcgagaaagaccgactcgggggcgaaggcgtccgctccgcagtgggcgcagacggtctcgcactcaactagccaggtgagctcgggctgctcggggtcaaaaaccagttttccaccgttctttttgatgcgcttcttacctcgcgtctccatgagtctgtgtccgcgctcggtgacaaacaggctgtcggtgtccccgtagacggacttgatgggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaatgaggaggatttgatgttggcttgccctgccgcgatgctttttaggagactttcatccatctggtcagaaaagacaatttttttattgtcaagcttggtggcgaatgagccatagagggcgttggagagaagcttggcgatggatctcatggtctgatttttgtcacggtcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctcgccgcgcagtggctcgttggtccagcagagtctgccgcccttgcgcgagcagaacgggggcagcacatcaagcagatgctcgtcaggggggtccgcatcgatggtgaagatgcccggacagagttccttgtcaaaataatcaatttttgaggatgcatcatccaaggccatctgccactcgcgggcggccagcgctcgctcgtaggggttgaggggcggaccccagggcatgggatgcgtgagggcggaggcgtacatgccgcagatgtcatagacatagatgggctccgagaggatgccgatgtaggtgggataacagcgccccccgcggatgctggcgcgcacgtagtcatacaactcgtgcgagggggccaagaatgcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgtgcggccttgcggagcgaggtgtgcgtcagggcgaaggtatccctgaccatgactttcaagaactggtacttgaagtccgagtcgtcgcagccgccgtgctcccagagctcgaaatcggtgcgcttcttcgagagggggttaggtagagcgaaagtgacgtcattgaagagaatcttgcccgctcgcggcatgaaattgcgggtgatgcggaaaggacccgggacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtctcccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatctcgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccaccggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctccacggtggcggcgaggtcattcgagatgcggcccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcgttgcgggccgagaccgtgagctcgtcttccaggagccgaatgagctcggcgatggtggcgcgcacctcgcgctcgaaatccccgggggcctcctcctcttcctcttcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgctggtgagggtgtcctggaagtcgtccatgtcgacgaagcggtggtaggccccggtgttgatggtgtaggtgcagttggccatgagcgaccagttgacggtctgcaggccgggttgcacgacctcggagtacctgagccgcgagaacgcgcgcgagtcgaagacgtagtcgttgcaggtgcgcacgaggtactggtagccaactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggatgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcggccgaaaaccctgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccgcagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgatcaacatcttgcagagcatcgtagtgcaggagcgcagcctgagcctggccgagaaggtggcggcgatcaactactcggtgttgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgcttagcctgcgccgggcgctggtagggggcgccgccggcggcgaggagtcctacttcgacatgggggcggacctgcattggcagccgagccggcgcgccttggaggccgcctacggtccagaggacttggatgaggatgaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagactagcagacagggcttgcagacggtgaacctgagccaggctttcaagaacctgcgcggactgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaacttcttgctgaccaatagacagcagaagattccggcgcaatacgcgctgtcggccgaggaggagcgcatcctgagatatgtgcagcagagtgtagggcttttcctgatgcaggagggcgccacccccagcgccgcgctggacatgaccgcgcgcaacatggaacctagcatgtacgccgccaaccggccgttcatcaataagctgatggactacctgcaccgcgcggcggccatgaacacggactatttcaccaacgccatcctgaacccgcactggctcccgccgccggggttctacacgggcgagtacgacatgcccgaccccaacgacgggttcctgtgggacgacgtggacagcgcggtgttctccccgaccttgcaaaagcgccaggaggcggtgcgcacgcccgtgagcgagggcgcggtgggtcggagcccctttcctagcttagggagtttgcatagcttgccgggctcggtgaacagcggcagggtgagccgcccgcgcttgctgggcgaggacgagtacctgaacgactcgctgctgcaaccgccacgggtcaagaacgccatggccaataacgggatagagagtctggtggacaaattgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccagactggggcgacggatgttttgaatgcaaaataaaactcaccaaggccatagcgtgcgttctcttccttgttagagatgaggcgcgcggtggtgtctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacaccaacatgcccaatgtgaacgagtacatgttcaccagcaagtttaaggcgcgggtgatggtggctaggaagcatccagagggggtagttgaaacagatttgagtcaggataagcttgagtatcagtggtttgagtttaccctgcccgagggcaacttttccgagaccatgaccatagacctgatgaacaacgccatcttggaaaactacttgcaagtggggcgacaaaatggcgtgctggagagcgatataggagtcaagtttgacagcaggaatttcaagctgggctgggacccggtgaccaagctggtgatgccgggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaagggggcaacatccccgctctgctggatgtggaagcatacctcaacagcaagaatgatatggaggaggctaccaagaatgcaaacagagctgctgacaatggaggtggtgaaactaggggagatacttttctcaccaccgaacagctgagagccgctggcaaggagcttgttattaagccaatcaaggaagatgctagcaagaggagctacaatgtcatagatggcacccatgacaccctgtaccgaagctggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaagcgctcccagcagcaccccgtccgcgtccgcggtcacttccgcgctccctggggcgcttacaagcgcgggcggacttctaccgccgccgccgtgcgcaccaccgtcgacgacgtcatcgactcggtggtcgccgacgcgcgcaactacacccccgccccctccaccgtggacgcggtcatcgacagcgtggtggccgacgcgcgcgactatgccagacgcaagagccggcggcgacggatcgccaggcgccaccggagtacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctacccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagggaaaagctcaaagaccagaacttccagcagaaggtggtggacgggctggcctcgggcattaacggggtggtggacatcgcgaaccaggccgtgcagcgcgagataaacagccgcctggacccgcggccacccacggtggtggagatggaagatgcaactcctccgccgcctaagggcgagaagcggccgcggcccgacgcggaggagacgatcctgcaggtggacgagccgccctcgtacgaggaggccgtgaaggccggcatgcccaccacgcgcatcatcgcgccactggccacgggtgtaatgaaacccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagataggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagtccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcatacaaggcgcgcttcactctggccgtgggcgacaaccgggtgctagacatggccagcacttactttgacatccgcggcgtcctggaccgcggccccagcttcaaaccctactcgggcacggcttacaacagtctggctcccaagggcgcccccaactccagtcagtgggaacagaaaaaggccaatgggggagctgatgaaatggaaacacacacctttggcgtggctgctatgggaggaaaaaatattacagacaagggtttgcaaattggaacagatgaaaccaaagaggatgatgaagatgagatatatgctgacaaaacttttcaaccagaacctcaagttggagaagaaaactggaaagaaacatttgtttattatggaggaagagccattaagaaagacacaaaaatgaagccttgttatggttcctatgccagacctactaatgaaaagggcggacaggctaaatttttaaatggagaaaatggtcaaccatctaaagaacaagacataacaatggctttctttgatctaaggcaagctgatgcaggaggtaataaaaatcaagcagacgtggttatgtatgccgaaaatattaatcttgaaactccagacactcatgtggtgtataagccaggcaaggaagatgcaagctctgaaattaatttaactcagcagtccatggccaacagacccaactacatcggcttcagggacaactttgtggggctgatgtactacaacagcactggtaacatgggtgtgctggctggtcaagcatctcagttgaacgctgtggtcgacttgcaagacagaaacacagagctgtcttaccagctcttgctagattctctgggtgacagaaccagatactttagcatgtggaactctgcagtggacagctatgatcccgatgtcaggatcattgagaatcacggtgtggaagatgaacttccaaactattgttttccattggacggatgtggcagcagtactgcttttcagggagttaaagtaacgaatccggctaccagtacgaataataacacacaatggggtgttaacgatgaagttgcaacacataaccaaattgccagaggcaacctgtacgccatggagatcaacctccaggccaacctgtggaagagttttctgtactcgaatgtggccctgtacctgcccgactcctacaagtacacgccggccaacatcacgctgcccaccaacaccaacacctacgagtacatgaacggccgcgtggtagccccctcgctggtggacgcctacatcaacatcggcgcgcgctggtcgctggaccccatggacaatgtcaaccccttcaaccaccaccgcaacgcgggcctgcgctaccgctccatgctgctgggcaacggccgctacgtgcccttccacatccaagtgccccaaaagttctttgccatcaagaacctgctactgctcccgggctcctacacctacgaatggaacttccgcaaggatgtcaacatgatcctgcagagttccctcggcaacgacctgcgcgtcgacggcgcctccgtgcgcttcgacagcgtcaacctctacgccaccttcttcccaatggcgcacaacaccgcctccaccctggaagccatgctgcgcaatgacaccaacgaccagtccttcaacgactacctctcggccgccaacatgctctatcccatcccggccaaggccaccaacgtgcccatctccatcccctcgcgcaactgggccgcctttcgcggctggagtttcacacggctcaagaccaaggaaactccctccctcggctcgggtttcgacccctactttgtctactcgggctccatcccctacctcgacggaaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcacccaccatgcgccaggggcagccctaccccgccaacttcccctacccgctcatcggctccaccgcagtgccctccgtcacccagaaaaagttcctctgcgacagggtcatgtggcgcatccccttctccagcaacttcatgtccatgggcgcccttaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggtttcctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccacccagaccgtgcaggggcccgactccgccgcctgcggacttttctgttgcatgttcttgcatgctttcgtgcactggcccgaccgacccatggacggaaaccccaccatgaacttgctgacgggggtgcccaacggcatgctacaatcgccacaggtgctgcccaccctcaggcgaaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgctgcgctggggagggccacgttgcggaactggtacttgggataccacttgaactcggggatcaccagtttgggcactggggtctcggggaaggtttcgctccacatgcgccggctcatctgcagggcgcccagcatgtcaggcgcggaaatcttgaaatcgcagttgggaccggtgctctgcgcgcgcgagttgcggtacactgggttgcagcactggaacaccatcagactggggtacttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgaacgggcatcagcatcatccccgcgccgcgctgcatattcgggtagagggccttgacaaaggccgtgatctgcttgaaagcttgctgggctttggccccctcgctgaaaaacaggccgcagctcttcccgctgaactggttattcccgcacccggcatcatgcacgcagcagcgcgcgtcatggctggtcagttgcaccacgctccgtccccagcggttctgggtcaccttggccttgctgggttgctccttcagcgcacgctgcccgttctcactggtcacatccatctccaccacgtggtccttgtggatcatcaccgtcccatgcagacacttgagctgaccttccacctcggtgcagccgtggtcccacagggcactgccggtacactcccaattcttgtgcgcgatcccgctgtggctgaagatgtaaccttgcaacaggcgacccatcacggtgctaaatgttttctgggtggtgaaggtcagttgcagggcgcgggcctcctcgttcatccaggtctggcacatcttctggaagatctcggtctgctcgggcatgagcttgtaagcatcgcgcaggccgctgtcgacgcggtagcgttccatcagcacgttcatggtatccatacccttctcccaggacgagaccagaggcagactcagggggttgcgcacgttcaggacaccgggggtcgcgggctcgacgatgcgttttccgtccttgccttccttcagcagaaccggaggctggctgaatcccactcccacgatcacggcatcttcctggggcatctcttcgtcggggtctaccttggtcacatgcttggtcttcctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacatgcgagcccaacccgcgtctcaacttctatcccgtctttgcggtccccgaggcccttgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgaaagtcaggagcaacgccccgaggacgcccggcccgtggtcagcgacgagatgctcgcgcgctggctcgggacccgcgacccccaggctttggaacagcggcgcaaactcatgctggccgtggtcctggtcaccctcgagctagaatgcatgcgccgcttcttcagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctgggacagaccgtactccactctaccctaaagggcgaggcgcggcgggactatgtccgcgactgcgtctttctctttctctgccacacatggcagtctgccatgggtgtgtggcagcagtgtctcgaggacgagaacctgaaggagctggacaagcttcttgctagaaaccttaaaaatctgtggacgggcttcgacgagcgcaccgtcgcctcggacctggccgagatcgtcttcccagagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctatctcttgcagctggccaactacatcgcctaccactcggacgtgatcgaggacgtgagcggcgaggggctgctcgagtgccactgccgctgcaacctgtgctccccgcaccgctccctggtctgcaacccccagctacttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgaaataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggtcaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcagaggagtcgccggaggaggaggaggcctgaggatcgcggcgaacgagccctcgaccaccagggagctgaggaaccggatcttccccactctttatgccatttttcagcagagtcgaggtcagcagcaagagctcaaagtaaaaaatcgatctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggcagcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaactctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcgccaccgagtctcacctggtcaggttcttcacccagcaacccttcctggtcgagcgggaccggggcgccaccacctacaccgtctactgcatctgtcctaccccgaagttgcatgagaatttttgctgtactctttgtgctgagtttaataaaagctgaaataagaatcttctctggaccttgtcatcgacctcggaacagcaccgtcttactcaccaatcagaccaaggttcgtctgaactgcacaaccaacaggaagtaccttctctggactttccaaaacacctcactcgctgttgtcaacgcccgtgacgacgacggtgttttaatccccaacaacctcaccagtggacttactttcagcacaagaaaaactaagctcgtcctccacaaaccttttgtagagggaacctaccagtgccgacacggaccctgtgttcacaacttccatttggtgaaccttaccagcagcagtacagttgctcctgaaacaactaacctttcttctgatactaacaaacctcgtgtcggaggtgagctttgggttccctctctaacagagggtgggagttctattgaagtggttgggtatttgattttaggggtggtcctgggtgggtgcatagcggtgctatatcaccttccttgctgggtcgaaatcagagtctttatctgctgggtcagacattgtggggaggaaccatgaaggggctcttgctgattatcctttccctggtggggggtgtactgtcatgccacgaacagccacgatgtaacatcaccacaggcaatgagagaagcgaatgctctatagtgatcaaatgtgagcacaaatgttctctcaacatcacattcaagaataagaccatgggaaatgtatgggtgggattctggcaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggagaacatggttgggttttctttggcttttgtgatcatggcctgtgcaatgtcaggtctgctggtaggggctataatatggttcctgaggcacaagcccaggtatggaaatctggaaaaggaaaaattgctataaatgtttttctttccacagcatcatgaatacagtgatccgtatcgtgctgctctctcttcttgtagcttttagtcaggcaggatttcatactatcaatgctacatggtgggctaatataactttagtgggaccctcagatacgccagtcacctggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaataaaacattagttggacctccaggaataccagttacttggtatgacggagaaggaaataaattctgcgatggagaaaaagttgaacatgcagaatttaatcatacatgtgacgtgcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaactgggcaaaaacaaaatgagcataaacagggtgggcagaaacaggaggggcaaaaagagacaagtcaaaagaaagctaatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgtgaacctggatataagttaaactgtaagtgtgacaatcaaaacctaaccctaatcaatgtaactaaactttatgagggagtttactatggtactaatgacggaggcaatggcaaaagatacagagtaaaagtaaacactacgaattctcaaaatgtgaaaattcagccgtacaccaggcctactactcctgatcagaaacacagatttgaattgcaaattgattataatcaagacaatgacaaaattccatcaactactgtggcaatcgtggtgggtgtgattgcgggcttcataactctgatcattgtcattctgtgctacatctgctgccgcaagcgtccaagggcatacaatcatatggtagacccactactcagcttctcttactgagactcagtcactttcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttacagcctataaatgcttcagtaatggaagcattacaattactgccactgctaatattacttctggcacaatcaaggcagaaagctataaaaatgaaatgaaaaaaatggtatataaaaataacaagacaacatttgaagattctggaaattatgagtatcagaaattatctttttataatctgacaattattgagctgccaactactaaggctcccacagttaggacaacgcagcctaccactgtacccactacacatccaaccacaactcacactacacagttagacactacagtgcagaatagtactgtattggttaggtatttgttaagagaggaaagtactactgaacagacagaggctacctcaagtgccttcagcagcactgcaaatttaacttcgcttgcttcgactaatgaaaccggagtatcattgatgtatggccaacattacccaggtttggatatacaaatcactttcttgattgtctgtggggtctttattctcgctgtccttctctactttgtctgctgcaaagccagagagaaatctagtaggcccatctacaggccagtaatcggggagcctcagccactgcaagtggaagggggtctaaggaatcttctcttctctttttcagtatggtgatcagccatgattcctaggttcttcctatttaacatcctcttctgtctcttcaacatctgcgctgccttcgcggccgtctcgcacgcctcgcccgactgtctcgggcccttccccacctacctcctctttgccctgctcacctgcacctgcgtctgcagcattgtctgcctggtcgtcaccttcctgcagctcatcgactggtgctgcgcgcgctacaattatctccaccacagtcccgaatacagggacgagaacgtagccagaatcttaaggctcatatgaccatgcagactctgctcatactgctattcctcctatctcctgcccttgctgatgatgattactctaagtgcaaatttgtggagctatggaatttcttagactgctatgatgctaaaatggatatgccttcctattacttggtaattgtggggatagtcatggtctgctcctgcactttctttgccatcatgatctacccctgttttgatctcggctggaactctgttgaggcattcacatacacactagaaagcagttcactagcctccacgccaccacccacaccgcctccccgcagaaatcagtttcccatgattcagtacttagaagagccccctccccggcccccttccactgttagctactttcacataaccggcggcgatgactgaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccaacggcaaacagcatcgcctcacctatgagatgccccagcagaagcagaagttcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactgatgttgattaaaagcccaaaaaccaatcagccccttaccccattcccctcccacaattactcataagaataaatcattggaattaatgtttcaataaagatcacttacttgaaatctgaaagtatgtctctggtgtagttgttcagcaacacctcagtaccctcctcccagctctggtattccagtccccggcgggcggcaaactttctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaactttccccctggtgtgctgtcactcaaattggctgacccaatcactatcagtaatggcgatgtctcactcaaggtgggagggggactcactgtggaacaagatagtggaaacctaagtgtgaaccctaaggctccattgcaagttggaacagacaaaaaactggaattggctttagcacctccatttgatgtcagagataacaagctagctattctagtaggagatggattaaaggtaatagatagatcaatatctgatttgccaggattgttaaactatcttgtagttttgactggcaaaggaattggaaatgaagaattaaaaaatgacgatggtagcaataaaggagtcggtttatgtgtgagaattggagaaggaggtggtttaacttttgatgataaaggttatttagtagcatggaacaagaaacatgacatccgcacactttggacaactttagacccttctccaaattgtaagatagatatagaaaaagactcaaaattaactttggtactgacaaagtgcggaagtcagattttggcaaatgtatctctaattatagttaacggaaagttcaagatccttaataacaaaacagacccatccctacctaaatcatttaacatcaaactactgtttgatcaaaatggagttctattggaaaattcaaacattgaaaaacagtacctaaactttagaagtggagactctattcttccagagccatataaaaatgcaattggatttatgcctaatttactagcttatgctaaagctacaactgatcagtctaaaatttatgcaaggaacactatatatggaaatatctacttagataatcagccatataatccagttgtaattaaaattacttttaataatgaagcaaatagtgcttattctatcacttttaactattcatggaccaaggactatgacaatgtcccttttgattctacttcatttaccttctcctatatcgcccaagaatgaaagaccaataaacatgttttcatttgaaaattttcatgtatctttattgatttttacaccagcacgggtagtcagcctcccaccaccagcccatttcacagtgtaaacaattctctcagcacgggtggccttaaataggggaatgttctgattagcacgggaactggatttagtgtctataagccacacagtttcctggcgagccaaacgggggtcggtgattgagatgaagccgtcctctgaaaagtcatccaagcgggcctcacagtccaaggtcacagtctggtggaatgagaagaacgcacagattcatactcggaaaacaagatgggtctgtgcctctccatcagcgccctcagcagtctttgccgccggggctcggtgcggctgctgcagatgggatcgggatcgcaagtctctctgactatgatccccacagccttcagcatcagtctcctggtgcgtcgggcacagcaccgcatcctgatctctgccatgttctcacagtaagtgcagcacataatcaccatgttattcagcagcccataattcagggtgctccagccaaaactcatgttggggatgatggaacccacgtgaccatcgtaccagatgcggcagtatatcag

SEQ ID NO: 1447 - DNA, 32767 bp, Human mastadenovirus C
catcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaatttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctatagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaaaagggtgagataatgtttaacttgcatggcgtgttaaatggggcggggcttaaagggtatataatgcgctgtgggctaatcttggttacatttgacctcatggaggcttgggagtgtttggaagatttttctgctgtgcgtaacttgctggaacagagctctaacagtacctcctggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatttgtggagagcggtggtgagacacaagaatcgcctactactgttgtcttccgtccgcccggcaataataccgacggaggagcagcagcagcaacagcagcagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggttaggaatttaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtacttggcatggacggggtggttattatgaatgtgaggtttactggccccaattttagcggtacggttttcctggccaataccaaccttatcctacacggtgtaagcttctatgggtttaacaatacctgcgtggaagcctggaccgatgtaagggttcgaggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctaacctgctcggacggcaactgtcacctgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgaaagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggagctgcgccagcaggtttctgccctgaaggcttcctcccctcccaatgcggtttaaaacataaataaaaaccagactctgtttggatttggatcaagcaagtgtattgctgtctttatttaggggttttgcgcgcgcggtaggcccgggaccagcggtctcggtcgttgagggtcctgtgtattttttccaggacgtggtagagatggctctggatgttcagatacatgggcataagcccgtctctggggtggaggtagcaccactgcagagcttcatgctgcggggtggtgttgtagatgatccagtcgtagcaggagcgctgggcgtggtgcctaaaaatgtcctttagaagcaagctgattgccaggggcaagcccttggtgtaagtgtttacaaagcggttaagctgggatgggtgcatacgtggggatatgagatgcatcttggactgtatttttaggttggctatgttcccagccatatccctcctgggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgataaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaagggggccacttcgttaagcatgtccctgacacgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgttcagacgggccagggtcatgtctttccacgggcgcagggtcctcgtcagcgtagtctgggtcacggtaaaggggtgcgctccgggctgcgcgctggccagggtgcgcttgaggctggtcctgctggtgctgaagcgctgccggtcttcgccctgcgcgtcggccaggtagcatttgaccatgatgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccggttggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtccccctcttcggcatcaaggaaggtgattggtttgtaggtgtatgccacgtgaccgggtgttcctgaagggggggtataaaagggggtgggggcgcgttcgtcctcactctcttccgcatcgctgtctgcgagggccagctgttggggtgagtactccctctggaaagcgggcatgacttctgcgctaaggttgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtccgcgtccacggtaaagatcccgggcaacaggcgcgcgtcgaagtagtctatcttgcatccttgcaagtctaacgcctgctgccatgcgcgggcggcaagcgcgcgctcgtatgggttgagtgggggaccccatggcatggggtgggtgagcgcggaggcgtacatgccgcagatgtcgtaaacgtagaggggctccctgagtattccaagatatgtagggtagcatcttccaccgcggatgctggcgcgcacgtaatcgtatagttcgtgcgagggggcgaggaggtcgggaccgaggttgctacgggcgggctgctctgctcgaaagacgatctgcctgaagatggcatgcgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcgggtttggtagggcgaaggtgacatcgttgaagagtatctttcccgcgcgaggcataaaattgcgtgtgatgcggaagggtcccggcacctcggaacggttgttaattacctgggcggcgagcacgatctcgtcaaagccgttgatgttgtggcccacgatgtaaagttccaagaagcgcggggtgcccttaatggagggcaattttttaagttcctcgtaggtaagctcttcaggggagctgagcccgtgctctgacagggcccagtctgcaagatgagggttggaagcaacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccacggctaggtctcgcgcggcggtcactagaggctcatctccgccgaacttcatgaccagcatgaagggcacgagctgctttccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagggggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgttgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcagaggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacagcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcagtggttgaggcgcgcgaaaagtcgcggacgcggttccagatgttgcgcagcggcaaaaagtgctccatggtcgggacgctctggccggttaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggctgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgatgacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccatgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagttgtttcttatagtgcagcacagcagggacaacgaggcattcagggatgcactgctaaacatagtagagcccgagggccgctggctactcgatttgataaatattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatatttctgatcagatgatgcaagacgcaacggacccggcggtgcgggcggcgctgcagagccagccgtccggccttaactccacggacgactggcgccaggtcatggaccgcatcatgtcgctgactgcgcgcaaccctgacgcgttccggcagcagccacaggccaaccggctctccgcaattctggaagcggtggtcccggcgcgcgcaaaccccacgcacgagaaggtgctggcgatcgtaaacgcgctggccgaaaacagggccatccggtccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgagaggccataggtcaggcgcatgtggacgagcatactttccaggagattacaagtgttagccgcgcgctggggcaggaggacacgggcagcctggaggcaaccctaaactacctgctgaccaaccggcggcagaagatcccctcgttgcacagtttaaacagcgaggaggagcgcattttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaagaacctgcctccggcgtttcccaacaacgggatagagagcctagtggacaagatgagtagatggaagacgtatgcgcaggaacacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgtcccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagcgtggtgagcgcggcgccagtggcggcggcgctgggttcccccttcgatgctcccctggacccgccgttcgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttgaaagatgacaccgaacagggcgggggtggcgcaggcggcggcaacaacagtggcagcggcgcggaagagaactccaacgcggcagccgcggcaatgcagccggtggatgacatgaacgatcatgccattcgcggcgacacctttgccacacgggcggaggagaagcgcgctgaggccgaggcagcggccgaagctgccgcccccgctgcggaggctgcacaacccgaggtcgagaagcctcagaagaaaccggtgattaaacccctgacagaggacagcaagaaacgcagttacaacctaataagtaatgacagcaccttcacccagtaccgcagctggtaccttgcatacaactacggcgaccctcaggccgggatccgctcatggaccctgctttgcactcctgacgtaacctgcggctcggagcaggtatactggtcgttgcccgacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcagccctgcttaaccgcgcacgtcgcaccggccgacgggcggccatgcgagccgctcgaaggctggccgcgggtattgttactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgttgcacgcgaccgcgcccaggcggcgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaaaacctctacggaggtgcaaacggacccgtggatgtttcgcgtttcagccccccggcgtccgcgccgttcgaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgattgccgcggcgattggcgccgtgcccggaattgcatccgtggccttgcaggcgcagagacactgattaaaaacaagttgcatgtggaaaatcaaaataaaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagtaaggcctggaacagcagcacaggccagatgctgagggacaagttgaaagagcaaaactttcagcaaaaggtggtagatggtctggcctctggcattagcggggtggtggacctggccaaccaggcagtgcaaaataagattaacagtaagcttgatccccgccctcccgtagaggagcctccaccggccgtggagacagtgtctccagaggggcgcggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacgcccgtaacgctggacctgcctccccccgccgacacccagcagaaacctgtgctgccaggcccgtccgccgttgttgtaacccgtcctagccgcgcgtccctgcgccgtgccgccagcggtccgcgatcgttgcggcccgtagccagtggcaactggcaaagcacactgaacagcatcgtgggtctgggggtacaatccctgaagcgccgacgatgcttctaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggtttatccctgtggaccgcgaggatactgcgtactcgtacaaggcgcggtttaccctagctgtgggtgataaccgtgtgctggacatggcttccacgtactttgacattcgcggcgtgctggaccggggccccacttttaagccctactccggcactgcctacaacgccctagctcccaagggtgcccccaactcatgcgagtgggatgaagatgatactcaggtacaggtagcggctgaagacgatcaagacgacgacgaagaagaggaacaactacctcagcagagaaatggcaaaaaaactcacgtatatgctcaggcaccgtttgctggcgaagcaattaacaaaaacggcctgcagataggaactaacggtgcagccactgaaggaaataaggaaatttacgcagataaaacttatcaacctgaaccacaaataggagaatcacagtggaacgaagccgaatcgtccgtagcaggtggaagggttcttaaaaagactactcccatgaaaccatgctatggctcctatgccagacctaccaattctaacggaggtcagggcgttatggttgaacaaaatggtaaattggaaagtcaagtagaaatgcaatttttttcaacttctgtaaatgctatgaacgaggcaaacgctattcaacctaaactagtgttgtatagtgaagatgtaaatatggaaaccccagacactcatctttcttataagcctggaaaaagtgatgataattctaaggcaatgttgggtcaacaatctatgccaaacagacccaattacatagctttcagggacaattttattggcctaatgtattacaacagcactggtaacatgggtgttcttgctggtcaggcatcacagctaaatgctgtcgtagatttgcaagacagaaacacagagctgtcctaccaacttttgcttgattctattggtgatcgaaccagatacttttccatgtggaatcaggctgtagacagctacgatccagatgttagaattatcgagaaccatggaactgaggatgaattgccaaattattgttttcctcttggcggaattggggtgacggacacctatcaagctattaaggctacaaatggaaatggaggcgccactacctgggctcaggacaatacttttgcagaacgaaatgaaataggggtgggaaataactttgccatggaaattaacctgaatgccaacctatggagaaatttcctttactccaatattgcgctgtacctgccagacaagctaaaatacaaccccaccaatgtggaaatatctgacaatcccaacacctacgactacatgaacaagcgagtggtggctcccgggctggtggattgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgatcttagggttgacggggctagcattaagtttgacagcatttgtctttacgccaccttcttccccatggcccacaacacggcctccacgctggaagccatgcttagaaatgacaccaacgaccagtcctttaatgactatctttccgccgccaacatgctataccccatacccgccaacgccaccaacgtgcccatctctatcccctcgcgcaactgggcggctttccgaggctgggcgtttacgcgccttaagactaaggaaaccccatccctgggttccggctacgacccttactatacctactctggctccataccctacctagacggaaccttttaccttaatcacaccttcaaaaaggtggccatcacctttgactcttctgttagctggcctggcaatgaccgtctgcttacccccaacgagtttgaaatcaagcgttcagtcgacggagagggctacaacgttgctcaatgcaacatgaccaaagactggttcttggtacagatgctggccaactacaacataggctaccagggcttttatatcccagaaagctacaaggaccgcatgtactccttctttagaaacttccagcccatgagccgtcaggtggtggacgataccaaatacaaggactaccaacaggtgggcatccttcaccagcacaataactctggctttgttggttacctcgctcccaccatgcgagagggacaggcttaccccgccaacttcccctacccgcttataggcaagaccgcggttgacagtattacccagaaaaagtttctttgcgaccgcaccctttggcgcattccattctccagtaactttatgtccatgggcgcactcacagacctgggccaaaaccttctctatgcaaactccgcccacgcgctagacatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacaactgccgccatgggctccagtgagcaggaactgaaagccattgtcaaagatcttggttgtggaccatattttttgggcacctatgacaagcgcttcccaggctttgtttccccacacaagctcgcctgtgccatagttaacacggccggtcgcgagactgggggcgtacactggatggcctttgcctgggacccgcgctcaaaaacatgctacctttttgagccctttggcttttctgaccagcgtctcaagcaggtttaccagtttgagtacgagtcacttctgcgccgtagcgccattgcctcttcccccgaccgctgtataacgctggaaaagtccactcaaagcgtgcaggggcccaactcggccgcctgtggcctgttctgctgcatgtttctccacgccttcgccaactggccccaaactcccatggatcacaaccccaccatgaaccttattaccggagtacccaactccatgcttaacagtccccaggtacagcccaccctgcgccgcaaccaggaacagctctacagcttcctggagcgccactcgccctacttccgcagacacagtgcgcaaattaggagtgccacttctttttgtcacttgaaaaacatgtaaaaataatgtactaggagacactttcaataaaggcaaatgcttttatttgtacactctcgggtgattatttaccccccacccttgtcgtctgcgccgtctaaaaatcaaaggggttctgccgcgcatcgctatgcgccactggcagtgacacgttgcgatactggtgtttagtgctccacttaaactcaggcacaaccattcgcggcagctcggtaaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggttgtgcacgctggccagcacgctcttgtcggagatcagatccgcgtctaggtcctccgcgttgctcagggcgaacggagtcaactttggtagctgccttcccaaaaagggcgcgtgcccaggctttgagttgcactcgcaccgtagtggcatcagaaggtgaccgtgcccggtttgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggctttgctagactgctccttcagcgcgcgctgcccattttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggtcacctctgcaaacgactgcaggtacgcctgcaagaatcgccccatcatcgtcacaaaggtcttgttgctggtgaatgtcagctgcaacccgcggtgctcctcgtttagccaggtcttgcatacggccgcgagagcttccacttggtcaggcagtagcttgaagttcgcctttagatcgttatccacgtggtacttgtccattagcgcgcgcgcagcctccatgcccttctcccacgcagacacgatcggcagactcaacgggttcattaccgtgctttcactttctgcttcactgggctcttcctcttcctcttgagtccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacaatcacctctggggatggcgggcgctcggacttgggagaggggcgcttctttttcttcttgggcgcgttggccaaatccgccgccgaggttgatggccgcgggctgggtgtgcgcggcaccagcgcgtcctgtgacgagtcttcttcgtcctcggactcgagacgccgcctcagccgcttttttgggggcgcgcggggaggcggcggcgacggcgacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctgaccttgcgacagggcgctgtcatacctgatatcgcctcgctcgacgaagtgccaaaaatctttgagggtcttggacgcgacgagaagcgcgcggcaaacgctctgcaacaggaaaacaacgaaaatgaaagttactctggagtgctggtggaacttgagggtgacaacgcgcgcctagccgtgcttaaacgcagcatcgaggtcacccactttgcctacccggcacttaacctgccccccaaggttatgagcacagtcatgagcgagctgatcgtgcgccgtgcacggcccctagagagggatgcaaacttgcaagaacaaacagaggagggcctgcccgcagttggcgacgagcagctagcgcgctggcttcagacgcgcgagcctgccgacttggaggagcgacgtaagctaatgatggccgcagtgctcgttaccgtggagcttgagtgcatgcagcggttctttgctaacccggagatgcagcgcaagctagaggaaacgttgcactacacctttcgccagggctacgtgcgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttgtttctatgctacacctggcagacggccatgggcgtgtggcagcagtgcctggaggagcgcaacctcaaggagctgcagaagctgctaaagcaaaacttgaaggacctatggacggccttcaatgagcgctccgtggccgcgcacctggcggacatcatcttccccgaacgcctgcttaaaaccctgcaacagggtctgccagactttaccagtcaaagcatgttgcaaaactttaggaactttatcctagagcgctcaggaattctgcccgccacctgctgtgcgcttcctagcgactttgtgcccattaagtaccgcgaatgccctccgccgctttggggtcactgctaccttctgcagctagcaaactaccttgcctaccactccgacatcatggaagacgtgagcggtgacggcctactggagtgtcactgtcgctgcaacctatgtaccccgcaccgctccctggtctgcaattcgcagctgcttagcgagagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcccaatgcggagcttaccgcctgcgtcattacccagggccacatccttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccgccacccacggacgaggaggaatactgggacagtcaggcagaggaggttttggacgaggaggaggagacgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaatcgtagatgggacaccactggaaccagggccggtaagtccaagcagccgccgccgttagcccaagagcaacaacagcgccaaggctaccgctcgtggcgcgggcacaagaacgccatagttgcttgcttgcaagagtgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcacccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcagatttaagcgcgaaaactacgtcatctacaacggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggtatacgcgcccaccgaaaccgaattctcctggaacaggcggccattacaaccacacctcgtaataaccttaatccccgtagttggcccgctgccctggtttaccaggaaagtcccgctcccaccactgtggtacttcccagagacgcccaggccgaagtccaaatgactaactcaggggcgcagcttgcgggcggctttcgtcatagggtgcggtcgccagggcagggtataactcacctgaaaatcagagggcgaggtattcagctcaacgacgagtcggtgagctcctcgcttggtctccgtccggacggaacatttcagatcggcggcgccggccgctcttcattcacgcctcgtcaggcgatcctaactttgcagacctcgtcctcggagccgcgctccggaggcattggaactctacaatttattgaggagttcgtgccttcggtttacttcaaccccttttctggacctcctggccactacccggaccagtttattcccaactttgacgcggtgaaggactcggcggacggctacgactgaatgactagtggagaggcagagcaactgcgtctaacacacctcgaccactgccgccgccacaagtgctttgcccgcgactccggtgagttttcctattttgagttgcccgaagagcatatcgagggcccggcgcacggcgtccggctcaccacccaggtagagcttacacgtagcttgattcgggagtttaccaagcgccccctgctagtggagcgggagcggggtccctgtgttctaaccgtggtttgcaactgtcctaaccctggattacatcaagatctttgttgtcatctctgtgctgagtataataaatacagaaattagaatctactggggcttctgtcgccatcctgtgaacgccaccgtttttacccacccaaagcagaccaaagcaaacctcacctccggtttgcacaagcgggccaataagtaccttacctggtactttaacggctcttcatttgtaatttacaacagtttccagcgagacaaagtaagtttgccacacaaccttttcggcttcaactataccatcaagaaaaacaccaccaccctccttacctgccgggaacgtacgagtgcgtcaccggttgctgcgcccacacctacagcctgaccgtaaccagacattactcccattttcccaaaacaggaggtgagctcaacttccgaaaatcagggcaaaaagcattttgctgattgtagtcggggtgctgagattttttaattaagtatatgagcaattcaagtaactctacaagcttgtctaatttttctggaattggggtcggggttatccttactcttgtaattctgtttattcttatactagcacttctgtgccttagggttgccgcttgctgcacgcacgtttgtatctattgtcagctttttaaacgctgggggcgacatccaagatgagatacataattttatgcatgctcgcccttgcggcagtctgcagtgctgccaaaaaggttgagtttaaggaaccagcttgcaatgttacatttaaatccgaagctaatgaatgcaccactcttataaaatgcaccacagaacatgaaaagcttattattcgccacaaagacaaaattggcaagtatgctgtatatgctatttggcagccaggtgatactaacgactataatgtcacagtcttccaaggtgaaaatcataaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttagtatgtaccctactttatctcaaatacaaaagcagacgcagttttattgatgaaaagaaaatgccttgattttccgcttgctaaacccttgccaacaaaagccaatgtataataatgtaaccaccgcggtgttactgcttgtattcccctggacaatttactctatgtgggatatgcgccaggcgggaaagattatacccacaaccttcaaatcaaactttcctggacgttagcgcctgacttctgccagcgcctgcactgcaaatttgatcaaacccagcttcagagagatgaccggctcaaccatcgcgcccacaacggactatcgcaacaccactgctaccggactaaaatctgccctaaatttaccccaagttcatgcctttgtcaatgactgggcgagcttgggcatgtggtggttttccatagcgcttatgtttgtttgccttattattatgtggcttatttgttgcctaaagcgcagacgcgccagaccccccatctataggcctatcattgtgctcaacccacacaatgaaaaaattcatagattggacggtctgaaaccatgttctcttcttttacagtatgattaaatgagacatgattcctcgagtccttatattattgacccttgttgcgcttttctgtgcgtgctctacattggccgcggtcgctcacatcgaagtagattgcatcccacctttcacagtttacctgctttacggatttgtcacccttatcctcatctgcagcctcgtcactgtagtcatcgccttcattcagttcattgactggatttgtgtgcgcattgcgtaccttaggcaccatccgcaatacagagacaggactatagctgatcttctcagaattctttaattatgaaacggattgtcacttttgttttgctgattttctgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatacccataccttgacattggttggaatgccatagatgccatgaaccaccctactttcccagcgcccaatgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctgcaccagtgtaaaagaggtatcttttgtgtggtcaagcaggccaaacttacctacgaaaaaaccactaccggcaaccgccttagctacaagctacccacccagcgccaaaaactggtgcttatggtgggagaaaaacctatcaccgtcacccagcactcggcagaaacagaaggctgcctgcacttcccctatcagggtccagaggacctctgcactcttattaaaaccatgtgtggcattagagatcttattccattcaactaacaataaacacacaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtgatctctgacaacactcttaccatgcaatcacaagcaccgctaaccgtgcaagactcaaaacttagcattgctaccaaagagccacttacagtgttagatggaaaactggccctgcagacatcagcccccctctctgccactggtaacaacgccctcactatcactacctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatatgataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcatggaacagtggacaatacactaatgacaaatttgccaccaattcctataccttctcctacatttcccaggaataaagaatcgtgaacctgttgcatgttatgtttcaacgtgtttatttttcaattgcagaaaatttcaagtcatttttcattcagtagtatagccccaccaccacatagcttat

SEQ ID NO: 1448 - DNA, 32767 bp, Human adenovirus 56
catcatcaataatataccccacaaagtaaacaaaagttaatatgcaaatgagtttttgaattttaacggtttcggggcggagccaacgctgattggacgagagaagacgatgcaaatgacgtcacgacgcacggcgttaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgactgtggaggaacaagtagtgattgaaaattctaccgagccagtggagggctgtagaaaatgccagtaccaccgggataagtctggagacccgaacgcatcatgcgctctgtgctatatgaaacagactttcagctttatttacagtaagtggagtgaatgtgagagaggctgagtgcttaacacatcactgtgtattgcttaaacagctgtgctaagtgtggtttatttttgtttctaggtccggtgtcagaggatgagtcatcaccctcagaagaagaccacccgtctccccctgatctcacagatgacacgcccctgcaagtgcacagacccaccccagtcagagccagtggcgagaggcgagcagctgttgaaaaaattgaggacttgttacatgacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggaagacacaccaggatgcagccagtggccctggatgtgaccgaggagctgagaccagaccacctggtgatggcctgtaccgggaccgagttcagctccagtggggaggacacagattagaggtaggtcgagtgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgagaaggagactgatggccacggggagccccttggtgtaggtattggcaaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcattcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgatgaaaaaaacggtttccggggctggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccgaacgagctcgccgaggaggcggtccccgcccagcgagaggagctcttgcagggaagcaaagtttttcaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgagcccctggctgggcgcttgcaagggtgcgcttgagactcatcctgctggtgctgaaacgggcacggtcttcgccctgcgagtcggcgagatagcagttgaccatgagctcgtagttgaggacctcggcggcgtggcccttggcgcggagcttgcccttggaagagcgcccgcaggcgggacagaggagggattgcagggcgtagagcttgggggcgagaaagacggactcgggagcgaaagcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccactagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcattggagagaagcttggcgatggatctcattgtctgatttttgtcacggtcggcgcgctccttggccgcgatgttgagctggacatactcgcgcgcgacgcacttccattccgggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacggtggcagcacatcaagcagatgctcgtcaggggggtccgcatcgatggtgaagatgcccggacagagttccttgtcaaaataatctatttttgaggatgcatcatccaaggccatctgccactcgcgggcggccagcgctcgctcgtaggggttaaggggcggaccccagggcatgggatgcgtgagggcggaggcgtacatgccgcagatgtcatagacatagatgggctccgagaggatgccgatgtaggtgggataacagcgccccccgcggatgctggcgcgcacgtagtcatacaactcatgcgagggggccaagaaggcggggccgagattggtgcgctggggctgctcggcgcggaagacgatctggcgaaagatggcatgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcttctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttttccacggggagggcgtaagcttgtgcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagaggggattaggcagagcgaaagtgacgtcattgaagagaatcttgcctgctcgcggcatgaaattgcgggtgatgcggaaagggcccgggacggaggctcggttgttgatgacctgggcggcaaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcgggttcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggctttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcgggcgtgctcccggcggcagcggcggttctggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcggcccatgagctgcgagaaggcgcccaggccgctctcgttccagacgcggctgtagaccacgtccccgtcggcgtcgcgtgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcattgcgggccgagaccgtgagctcgtcttccaggagcctgatgagctcggcgatggtgacgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcaatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcatccatgtcgacgaagcggtggtaggccccggtgttgatggtgtaggtgcagttggccatgagcgaccagttgacggtctgcaggccgggttgcacgacctcggagtacctgatccgcgagaaggcgcgcgagtcgaagacgtagtcgttgcaggtgcgcacgaggtactggtagccgactaggaagtgcggtggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagggggtcgctagacttgaaagcggctgaaaaccccgccgggtagtggctcgcgcccgtagtctggagaagcatcgccagggttgagtcgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcaagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccagcctggtgacggcctacgaacagacggtgaagcaggagcgcaacttccaaaagagtttcaacaaccacgtgcgcacgctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagccttcgccgggcgctggtagggggcgctgccggcggcgaggagtcctacttcgacatgggggcggacctgcattggcagccgagccggcgcgccttggaggccgcctacggtccagaggacttggaagaggatgaggaagaggaggaggatgcacccgctgcggggtactgacgcctccgtgatgtgtttttagatgcagcaagccccggaccccgccataagggcggcgctgcaaagccagccgtccggtatagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtctggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcgtctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacggtatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggatttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcacgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggcccccaagggcgcccccaactccagtcagtgggaacagaaaaaggccaatgctggagaacaaaaggaaacacatacttatggtgtagctcctatgggtggagaaaacattacaattagcggtttgcaaattggaacagatactacaaatggcaaacaagacccgatatatgctaataagctgtatcaaccagagcctcaagtaggagaagaaaactggcaggaaacagaagccttctatggaggaagggctcttaaaaaggaaaccaagatgaaaccatgctatggctcatttgccagacccacaaatgaaaaaggaggacaggcaaaactaagagaccctgaaaaaagtcaagaagattttgacatagacctagcattctttgatactccgggaggaactttaacaggtggtggaacggaatacaaagcagacattgttatgtgcactgaaaatgttaatcttgaaaccccggacacccacgtggtgtataaaccaggcaaagatgatgacagttcagaaatcaacttggttcagcagtccatgcccaacagacctaactacatcggcttcagggacaactttgtgggtctcatgtactacaacagcactggcaacatgggtgtgctggccggtcaggcttctcagttgaatgctgtggtcgacttgcaagacagaaacacagagctgtcttaccagctcttgctagattctctgggcgacagaaccaggtactttagcatgtggaactctgcggtggacagctatgatcccgatgtcaggatcattgagaatcacggtgtggaagatgaacttcccaactattgcttcccattggatgggtctggcaccaatgctgcttatgaaggtgtaaaagttaaaaatggacaagatggggatcaagagagcgaatgggaaaaagacaccaatgtggcagatcgaaaccaaatatgcaagggcaacatctacgccatggagatcaacctccaggccaacctgtggaagagttttctgtactcgaacgtggcgctgtacctgcccgactcctacaagtacacgccggccaacgtcacgctgcccaccaacaccaacacctacgagtacatgaatggccgcgtggtagccccctcgctggtggacgcctacatcaacatcggcgcccgctggtcgctggatcccatggacaacgtcaaccccttcaaccaccaccgcaacgcgggcctgcgctaccgctccatgcttctgggcaacggccgctacgtgcccttccacatccaagtgccccaaaagttctttgccatcaagaacctgctcctgcttcccggctcctacacctacgagtggaacttccgcaaggatgtcaacatgatcctgcaaagttccctcggcaacgacctgcgcgtcgacggcgcctccgtccgcttcgacagcgtcaacctctatgccaccttcttccccatggcgcacaacaccgcctccaccctggaagccatgctgcgcaacgacaccaacgaccagtccttcaacgactacctctcagccgccaacatgctctaccccatcccggccaaggccaccaacgtgcccatctccatcccctcgcgcaactgggccgccttccgcggatggagtttcacccggctcaagaccaaagaaactccctccctcggctcgggtttcgacccctactttgtctactcgggttccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaatgtggcccaatgcaacatgaccaaggactggttcctcgtccagatgctctcccactacaacatcggctaccagggcttccatgtgccagagggttacaaggaccgcatgtactccttcttccgcaacttccagcccatgagcaggcaggtggtcgatgagatcaactacaaggactacaaggccgtcaccctgccattccagcacaacaactcgggcttcaccggctacctcgcacccaccatgcgtcaggggcagccctaccccgccaacttcccctacccgctcatcggccagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggtacccacgacaagcgcttcccgggtttcctcgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgaacagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggaactggtacttgggctgccacttgaactcggggatcaccagtttgggcactggggtctcggggaaggtctcgctccacatgcgccggctcatctgcagggcgcccagcatgtcaggcgcggagatcttgaaatcgcagttggggccggtgctctgcgcgcgcgagttgcggtacacggggttgcagcactggaacaccatcagactggggtacttcacactggccaacacgctcttgtcgctgatctgatccttgtccagatcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctgaaaaacaggccgcagctcttcccgctgaactgattattcccgcacccggcatcatggacgcagcagcgcgcgtcatggctggtcagttgcaccacgctccgtccccagcggttctgggtcaccttggccttgctgggttgctccttcagcgcacgctgcccgttctcactggtcacatccatctccaccacgtggtccttgtggatcatcaccgtcccatgcagacacttgagctggccttccacctcggtgcagccgtggtcccacagggcactgccggtgcactcccagttcttgtgcgcgatcccgctgtggctgaagatgtaaccttgcaacaggcgacccatgatggtgctaaagctcttctgggtggtgaaggtcagttgcagaccgcgggcctcctcgttcatccaggtctggcacatcttttggaagatctcggtctgctcgggcatgagcttgtaagcatcgcgcaggccgctgtcgacgcggtagcgttccatcagcacattcatggtatccatgcccttctcccaggacgagaccagaggcagactcagggggttgcgcacgttcagaacaccgggggtcgcgggctcgacgatgcgttttccgtccttgccttccttcaacagaaccggcggctggctgaatcccactcccacgatcacggcttcttcctggggcatctcttcgtctgggtctactttggtcacatgcttggtctttctggcttgcttcttttttggagggctgtccacggggaccacgtcctcctcggaagacccggatcccacccgctgatactttcggcgcttggttggcagaggaggtggcggcgaggggctcctctcctgctccggcggatagcgcgctgaaccgtggccccggggcggagtggcctctcggtccatgaaccggcgcacgtcctgactgccgccggccattgtttcctaggggaagatggaggagcagccgcgtaagcaggagcaggaggaggacttaaccacccacgagcaaccaaaaatcgagcaggacctgggcttcgaagagccggctcgtctagaacccccacaggatgaacaggagcacgagcaagacgcaggccaggaggagaccgacgctgggctcgagcatggctatctgggaggagaggaggatgtgctgctcaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggtgacaacgccaggctggccgtgctcaagcgcagcgtcgagctcacccactttgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaagctgatgctggccgtggtcctggtcaccctcgagctcgaatgcatgcgccgcttcttcagcgaccccgagaccctgcgcaaggtcgaggagaccctgcactacactttcaggcacggtttcgtcaggcaggcctgcaagatctgcaacgtggagctgaccaacctggtctcctgcctggggatcctgcacgagaaccgcctgggacagaccgtgctccactcgaccctgaagggcgaggcgcggcgggactatgtccgcgactgcgtctttctctttctctgccacacatggcaagcagccatgggcgtgtggcagcagtgtctcgaggacgagaacctgaaggaactggacaagcttcttgctagaaaccttaaaaagctgtggacaggcttcgacgagcgcaccgtcgcctcggacctggccgagatcgtgttccccgagcgcctaaggcagacgctgaaaggcgggctgcccgacttcatgagccagagcatgttgcaaaactaccgcactttcattctcgagcgatctgggatgctgcccgccacctgcaacgccttcccctcagactttgtcccgctgagctaccgcgagtgtcccccgccgctgtggagccactgttacctcttgcagctggccaactacatcgcctaccactcggacgtgatcgaggacgtgagcggcgaggggctgctcgaatgccactgccgctgcaacctgtgctccccgcaccgctccctggtctgcaacccccagctccttagcgagacccaggtcattggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcgtccgcagcacgcggatctcacggcctgcgtcatcacccagggcacgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgcagctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagaggagtcgtcggaggaggaggaggcctgaggatcgcggcgaacgagccctcgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcttggccgcgggcgcctcccaggactactccacccgcatgaattggctcagtgccggcccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagttgcatgagaatttttgctgtactctttgtggtgagtttaataaaagctaaactcttgcaatactctggaccttgtcgtcatcaactcaacgagaccgtctaccttaccaaccagactgaggtaaaactcacctgcagaccacacaagacctatatcatctggttcttcgagaacacctcatttgcagtctccaacactcactgcaacgacggtgttgaacttcccaacaacctttccagtggactgagttacgatacacgtagagctaagctcatcctctacaatccttttgtagagggaacctaccagtgccagagcggaccttgtactcacaccttccatttggtgaacgttaccggcagcagcacagccgctccagaaactaaccttccttctgatactatcaaacctcgtttcggaggtgagctaaggcttcccccttctgaggagggggttagcccttacgaagtggtcgggtatttgattttaggggtggtcctgggtgggtgcatagcggtgctagctcagctgccttgctgggtagaaatcaaaatctttatatgctgggtcagacattgtggggaggaactatgaaggggctcttgctgattatcctttccctggtggggggtgtgctgtcatgccacgaacagccacgatgtaacatcaccacaggcaatgagaggagtgtcatatgcacagtagtcatcaaatgcgagcatgaatgccctctcaacatcacattcaaaaaccgtaccatggggaatgcatgggtgggcgactgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggaaaacatggttgggttttctttggcttttgtgatcatggcctgctttatgtcaggtctgctggtaggagctctagtgtggttcctgaaacgcaagcccaggtatggaaatgaggaaaaggaaaaattgctataaattctttttcttttcacagcaccatgaatactttgaccagtgtcgtgctgctctctcttcttgtagcttttagtcaggcaggaattattaacttaaatgtatcatggggaatgaatctaactttagtgggaccctcagacctgccagttacatggtatgatggaaagggaatgcagttttgtgatggaaatacaattaagaacccacaaatcaagcatagctgtaatcaacagaatctaactttacttaatgctgacaagtctcatgaaagaacttacctaggttacagacatgacagtaaggaaaaagtagactataaggttacagtcataccacctcctccagccactcgcaagcctttgtcagagcctcattatgttactgtgactatgggcgataacataactttagtgggaccctcagacctgccagttacatggtatgatggagaaggaaataaattctgcgatggagaaaaagttgaacatgcagaatttaatcatacatgtaacatccagaacctgacactgctctttgtcaacttaacgcataatggagcatacattggttataacaaagacggttctgatagagaattatatgaggtgtcagtcaaaaccttgtttcagaacggggctggacaaagtaaggttgaacaaggtaataaagggaaacctaatactgctcaaagtggtggtaaaaaaaccaaaacagaacatagaaaccagagtccaaaaagaaaatcaacaaataaccttcagccaacacaattgtatgttaggccttttactaatgttagtttaactggacctccaaatggcaaggttacttggtatgatggcgaacttaatgatccatgtgaacaaaagtacaaactcagaactttttgcaatcagcaaaatctaactttaattaatgtaagcagcacttatgatggcatctattatggcactgatgaaaaagataaggcaaatcgttacagaataaaagtaaatactacaaatcacaaaactgttaaaattaagccacataccaaagaacctcctgctgtacaagaaaaacagtttgaattacaagatgcagaaactgatgaaaacgaatcaaaaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttactgcatataaatgcttcaataatggaagcattactattactgccactgccaacattacttctggcacatacaaagctgaaagctataaaaatgaaatcaaaaaactaacctataaaaacaacaaaaccacatttgaagattctggaaattatgaacatcaaaaattatctttttatatgttgacaataattgaactgcctacaactaaggctcccaccacagttaggacaactacagaaacaaccacacatccaaccactactcacactacagtgcaaaatactactttattgattgggtttttactgagagagaatgaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagagaaatctaggaggcccatctacaggccagtgattggggaacctcagccactccaagtggatggaggcttaaggaatcttctcttctcttttacagtatggtgatcagccatgattcctaggttcttcctatttaacatcctcttttgtctcttcaacatctgtgctgccttcgcggccgtctcgcacgcctcgcccgactgtctagggcctttccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggaatttcttagattgctatcaggagaaaattgatatgccctcctattacttggtgattgtgggaatagtcatggtctgctcctgcactttctttgccatcatgatctacccctgttttgatctcggctggaactctgttgaggcattcacatacacactagaaagcagttcactagcctccacgccaccgcccacaccgcctccccgcagaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgccttgtcaaacaggcaaagatcacctacgagctcgtgtccggcggcaagcagcatcgcctcacctatgagctgccccagcagaagcagaagttcacctgcatggtgggcgtcaaccccatagtcatcacccagcagtcgggcgagaccagcggctgcatccactgctcctgcgaaagccccgagtgcatatactccctcctcaagaccctttgcggactccgcgacctcctccccatgaactgatgttgattaaaagcccgaaaaccaatcagaccattcccccatttccccattcccaattactcataaaataaatcattggaattaatcattcaataaaaatcacttacttgaaatctgaaagtatgtctctggtgtagttgttcaacagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactagctgacccaatagccatcgtcaatgggaatgtctcactcaaagtgggagggggtctcactttgcaagatggaactggaaaactaacagtcaatgctgatccacctttgcaacttacaaacaacaaattagggattgctttggacgctccatttgatgttatagataataaactcacgttgttagcgggccatggcttgtctattataacaaaagaaacatcaacactgcctggcttgattaatactcttgtagtattaactggaaagggtattggaacagaatcaacagataatggcggaagcgtatgtgttagagttggagaaggtggcggcttatcatttaataatgatggagacttggtagcatttaataaaaaagaagataagcgcaccctatggacaactccagacacatctccaaattgcaagattgatcaggataaggactctaagttaactctggtccttacaaagtgtggaagtcaaatattggctaatgtgtcattaattgtcgtagctggtaagtacaaaattatcaataacaatactcaaccagctctcaaaggatttaccattaaattattgtttgatgaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtaaatgttgaatttgaaacaacctcttttaccttttcctatatcgcccaagaatgaaagaccaataaacgtgtttttcatttcaaaattttcatgtatctttattgatttttacaccagcacgggtagtcagtctcccaccaccagcccatttcacagtataaacaattctctcagcacgggtggccttaaatagggaaatgttctgattagtgcgggaactggacttggggtctataatccacacagtttcctggcgagccaagcggggatcggtgattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcagcagtctctgccgtcggggctctgtgcggctgctgcagatgggatcgggatcgcaagtctctctgactatgatccccacagccttcagcatcagcctcctggtgcgacgggcacagcaccgcatcctgatctctgccatgttctcacagtaagtgcagcacataatcaccatgttattcagcagcccataattcagggtgctccagccaaagctcatgttggggataatggaacccacgtgaccatcgtaccagatgcggcagtatatcaggtgcctgcccctcataaacacactgcccatatacatgatctctttgggcatgtttctgttcacaatctgacggtaccaggggaagcgctggttgaacatgcacccgtaaatgactctcctgaaccacacggccagcagggtgcctcccgcccga

SEQ ID NO: 1449 - DNA, 32767 bp, Human adenovirus 55
catcatcaataatataccttatagatggaatggtgccaatatgtaaatgaggtgattttaaaaagtgtgggctgtgtggtaattggctgtggggttaacggctaaaaggggcggcgcggccgtgggaaaatgacgttttttgggggtggagtgtttttgcaagttgtcgcggtaaatgtgacgtaaacaaaggctttttttctcacggaactacttagtgttcccacggtatttaacaggaaatgaggtagttttggccggatgcaagtaaaaattgttcattttcgcgcgaaaactaaatgaggaagtggttttctgaataatgcggtatttatggcagggtggagtatttgttcagggccaggtagactttgacccattacgtggaggtttcgattaccgcggaggtttcgattaccgtgttttttacctaaatttccgcgtaccgtgtgaaagtcttctgtttttacgtaggtgtcagctgatcgctacggtatttatacctcagggtttgtgtcaagaggccactcttgagtgccagcgagaagagttttctcctctgcgccggcagtttaatattaaaaaaatgagacacttgcgatttctgcctcaggaaataatttctgctgagactggaaacgaaatactggagtttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctttgagtgatgaggaggaccgtgaaaaggagcagtttatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaagttaaaatttaaaggaatatgctgtttttcacatgtatattgagtgggagatttgtgcttcttattataggtcctgtgtctgatgctgatgagtcaccatctcctgattctactacctcacctcctgagattcaagcacctgttcctgtggacgtgcacaagcccattcctgtaaagcttaagcctggaaaacgtccagcagtggaaaaacttgaggacttgttacagggtggggacggacctttggacttgagtacacggaaacggccaagacaataagtgtttacttaaggtgacgtcaatatttgtgtgagagtgcaatgtaataaaaatatgttaactgttcactggtttttattgctttttgggcggggactcaggtatataagtagaagcagacctgtgtggttagctcatagaagctggctttgattcatggaggtttgggccattttggaagaccttagaaagactaggcaactgttagagaacgcttcggacggagtctccggtttttggagattctggttcgctagtgaaatagctagggtagtttttaggataaaacaggactataaagaagaatttgaaaagttgttggtagattgcccaggactttttgaagctcttaatttgggtcatcaagttcactttaaagaaaaagttttatcagttttagacttttcgaccccaggtagaactgctgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtcttctgaactgcaacgggtgcttactggatctacgtccactggacgggataggggcgttaaaagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactccagacaagacagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggttttaacaatacctgtgtagatgcctggggacaggttagtgtacggggatgtagtttctatgcgtgttggattgccacagctggcagaaccaagagtcaattgtctctgaaaaaatgcatattccaaagatgtaacctgggcattcttaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggtgggcattgtaacatgctggctactgtgcatattgtttctcatcaacgcaaaaaatggcctgtttttgatcacaatgtgttgaccaagtgtaccatgcatgcaggtgggcgtagaggaatgtttatgccttaccagtgtaacatgaatcatgtaaaagtgttgttagaaccagatgccttttccagaatgagtctaacaggaatgtttgacatgaacatgcaaatctggaagatcctgaggtatgatgatacaagatcgagggtgcgcgcatgcgaatgcggaggcaagcatgccaggttccaaccggtgtgtgtagatgtgactgaagatctgagaccggatcatttggttattgcccgcactggagcagagttcggatccagtggagaagaaactgactaaggtgagtattgggaaaactttggggtgggattttcagatggacagattgagtaaaaatttgtttttctgtcttgcagctgtcatgagtggaaacgcttcttttaatgggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacccagctgcagccgccgctgccgcctctgttgccgctaacactgtgcttggaatgggttactatggaagcatcctggctaattccacttcctctaataacccttctaccctgactcaggacaagttacttgtccttttggcccagctggaggctttgacccaacgtctgggtgaactttctcagcaggtggccgagttgcgagtacaaactgagtctgctgttggcacggcaaagtctaaataaaaaaattccagaatcaatgaataaataaacgagcttgttgttgatttaaaatcaagtgttttttatttcatttttcgcgcacggtatgccctagaccaccgatctcgatcattgagaacacggtggattttttccaaaatcctataaaggtgggattgaatgtttagatacatgggcattaggccgtctttggggtggagatagctccattgaagggattcatgctccggggtagtgttgtaaattacccagtcataacaaggtcgctgtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcaatattgccgccaagatctcgtcttgggttcatgttatgaagtaccaccaagacggtgtatccggtacatttaggaaatttatcgtgcagcttggatggaaaagcgtggaaaaatttggagacacccttgtgtcctccgagattttccatgcactcatccatgataatagcaatagggccgtgggcagcagcgcgggcaaacacgttccgtgggtctgacacatcatagttatgttcctgagttaaatcatcataggccattttaataaatttgggacggagagtacccgattggggtatgaatgttccttcgggccccggagcatagttcccctcacagatttgcatttcccaagctttcagttccgagggtggaatcatgtccacctggggggctataaagaacaccgtttctggggctggagtaattagttgggatgatagcaagtttctgagcaattgagatttgccacatccggtggggccataaatgattccgattacaggttgcagttggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtctgttgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcaaagttcgggtcagggttgtttccgtcacagtgaaggggtgtgcgcctgcttgggcgcttgccagggtgcgcttcagactcatcctgctggtcgaaaacttgtgccgcttggcgccctgtatgtcggccaagtagcagtttaccatgagttcgtagttgagcgcctcggctgcgtggcccttggcgcggagcttacctttggaagttttcttgcataccgggcagtataggcatttcagcgcatacagcttgggcgcaaggaaaatggattctggggagtatgcatccgcgccgcaggaggcgcaaacagtttcacattccaccagccaggttaaatccggttcattggggtcaaaaacaagttttccgccatattttttgatgcgtttcttacctttggtctccatgagttggtgtcctcgttgagtgacaaacaggctgtccgtgtccccgtagactgattttacaggcctcttttccagtggagtgcctcggtcttcttcgtataggaactctgaccactctgatacaaaggcgcgcgtccaggccagcacaaaggaggctatgtgggaggggtagcgatcgttgtcaaccagggggtccaccttttccaaagtatgcaaacacatgtcactctcttcaacatccaggaatgtgattggcttgtaggtgtatttcacgtgacctggggtcccagctgggggggtataaaagggggcggttctctgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccgcttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgccaggcacttccattcggggaagatagttgtcaattcatctggcacaattctcacttgccaccctcggttatgcaaggtaattaaatccacactggtggccacctcgcctcgaaggggttcgttggtccagcagagcctacctcctttcctagaacagaaaggtggaagtgggtctagcataagttcatcgggagggtctgcatccatggtaaagattccaggaagtaaatccttatcaaaatagctgatgggagtggggtcatctaaggccatttgccattctcgagctgccagtgcgcgctcatatgggttaaggggactgccccagggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgacggcgctagcagccccggacccaagttggtgcgattgggtttttctgttctgtagacaatctggcgaaagatggcgtgagaattggaagagatggtgggtctttgaaaaatgttgaagtgggcatgaggtagacctacagagtctctgataaagtgggcataagattcttcaagcttggttaccagttcggcagtgacaagtacgtccagggcgcagtagtcaagtgtttcttgaatgatgtcataacctggttggtttttcttttcccacagttcgcggttcagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcgaaggtgtctctaaccatgactttgagaaattggtatttaaagtccatgtcgtcacaggctccctgttcccagagttggaagtctacccgtttcttgtaggcggggttgggcaaagcgaaagtaacatcgttgaagagaatcttaccggctctgggcataaaattgcgagtgatgcgaaaaggctgtggtacttccgctcgattgttgatcacctgggcagctaggacgatctcgtcgaagccgttgatgttgtgtcctacaatgtataattctatgaaacgcggcgtgcctctgacgtgaggtagcttattgagctcatcaaaggttaggtctgtagggtcagataaggcgtagtgttcaagggcccattcgtgcagatgaggatttgcatgtaggaatgatgaccaaagatccaccgccagtgctgtttgtaactggtcccgatactgacgaaaatgctggccaattgccattttttctggagtgacacagtagaaggtttcgggatcttgttgccatcgatcccacttaagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgatcgggaaaaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtattggcctgttcatcttctgtttcaatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcataatcttttccagggcgtgcgggaggtttagatggtacttgatttccacaggttcgtttgtagagacgtcaatggcttgcagggttccgtgtcctttgggtgccactaccgtacctttgttttttcttttgatcggcggtggctctcttgcttcttgcatgcttaaaagcggtgacggggacgcgcgccgggcggcagcggttgttccggacccgggggcatggctggtagtggcacgtcggcgccgcgcacgggcaggttctggtactgcgctctgagaagacttgcgtgcgccaccacgcgtcgattgacgtcttgtatctgacgtctttgggtgaaagctaccggccccgtgagcttgaacctgaaagagagttcaacagaatcaatttcggtatcgttaatagcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcgatgtgttcggcgacaaagaaatacatgatccatcgtctcagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcaaaggctcccggcatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggaaagggcgctgattatacattttattaattggcccgtagggactgcgcgcagagatctgatcgtgtcaagatccacgggatctgaaaacctttcaacgaaagcgtctaaccagtcacagtcacaaggtaggctgagtacggcttcttgtgggcgggggtggttatgtgttcggtctgggtcttctattccttcttcatctcgggaaggtaagacgatgctgctggtgatgaaattaaagtaggcagttctaagacggcggatggtggcgaggagcaccaggtctttgggtccggcttgctggatacgcaggcgattggccattccccaagcattattctgacatctagccagatctttgtagtagtcttgcatcagccgttctacgggcacttcttcttcacccgttctgccatgcatacgtgtgagtccaaacccgcgcattggttggaccagtgccaagtcagctacgactctttcggcgaggatggcttgctgtacttgggtgagggtggcttgaaagtcatcaaaatccacgaagcggtggtaagccccggtattgatggtgtaagcacagttggccatgactgaccagttaactgtttggtgaccagggcgcacgagctcggtgtatttaaggcgcgaataggcgcgggtgtcaaagatgtaatcgttgcaggtgcgcaccagatactggtaccctataagaaaatgcggtggtggttggcggtagagaggccattgttctgtagctggagcgccgggggcgaggtcttccaacataaggcggtgatagccgtaaatgtacctggacatccaggtgattcctgcggcggtagtggaagcccgaggaaactcgcgtacgcggttccaaatgttgcgtagcggcatgaagtagttcattgtaggcacggtttgaccagtgaggcgcgcgcagtcattgatgctctatagacacgaagaaaatgaaagcgttcagcgactcgactctgtagcctggaggaacgtgaacgggttgggtcgcggtgtaccccggttcaagacttgtactcgagccggccggagccgcggctaacgtggtattggcactcccgtctcgacccagcctacaaaaatccaggatacggaatcgagtcgttttgctggttgctgaatggcagggaagtgagtcctatttttttttttgccgctcagatgcatcccgtgctgcgacagatgcgtccccaacaacagcccccctcgcagcagcagcaaccacaaaaggctgtccctgcaactactgcaactgccgccgtgagcggtgcgggacagcccgcctatgatctggacttggaagagggcgaaggactggcacgtctaggtgcgccctcgcccgagcggcatccgcgagttcaactgaaaaaagattctcgcgaggcgtatgtgccccaacagaacctatttagagacagaagcggcgaggagccagaggagatgcgagcttcccgctttaacgcgggtcgtgagctgcgtcacggtttggaccgaagacgagtgttgcgggacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcacagctgtttctggtggtgcaacacagcagagacaacgaggctttcagagaggcgctgctcaacatcactgaacccgaggggagatggttgtatgatcttatcaacattttacagagtatcatagtgcaggagcggagcctgggcctggccgaaaaggtggctgccatcaattactcggttttaagtttgggaaaatattacgctcgcaagatctacaagactccatacgttcccatagacaaggaggtgaagatagatgggttctacatgcgcatgacgctcaaggtcttgaccctgagcgatgatcttggggtgtaccgcaatgacagaatgcatcgcgccgtgagcgccagtaggaggcgcgagttaagcgacagggaactgatgcacagtttgcaaagagctctgactggagctggaacagagggtgagaattactttgacatgggagctgacttgcagtggcagcctagtcgcagggctctaagcgccgcgacggcaggatgtgagcttccttacatagaagaggcggatgaaggcgaggaggaagagggcgagtacttggaagactgatggcgcaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccattgtgaacgcgttggtggagaacaaagctattcgtccagatgaggccggactggtatacaacgctcttttagaacgcgtggctcgctacaacagtagcaatgtacaaaccaatttggaccgtatgataacagatgtacgcgaagccgtgtctcagcgtgaaaggttccagcgcgacgccaacctgggttcgctagtggcgttaaatgcttttttgagtactcagcctgctaatgtgccgcgtggtcaacaggattatactaactttttgagtgcgttgagactgatggtatctgaagtacctcagagcgaagtgtatcagtccggacctgactacttctttcagactagcagacagggtttgcagacggtaaatctgagccaagcttttaaaaaccttaaaggtttgtggggagtgcatgccccggtaggagaaagagcaaccgtgtctagcttgttaactccaaactcccgcctactactactgttggtagctcctttcaccgacagcggcagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcggtctcagaagatccctcctcaatatgctcttactgcggaggaggagaggatccttagatatgtgcagcagagcgtgggattgtttttgatgcaagagggggcaactccgactgcggcattggacatgacagcgcgaaatatggagcccagcatgtatgccagtaaccggcctttcattaacaaactgctagactacttgcacagagctgccgctatgaactctgattattttaccaatgccatcttaaacccgcactggctgcccccacctggtttctacacgggcgaatatgacatgcccgaccctaatgacgggtttctgtgggacgacgtggacagtaatgttttttcacctctttttgatcatcgcacgtggaaaaaggaaggcggcgatagaatgcattcttctgcatcgctgtccggggtcatgggtgctaccgcggctgagcccgagtctgcaagtccttttcctagtctacccttttctttacacagtgtacgtagcagcgaagtgggtagaataagtcgcccgagtttaatgggcgaagaggaatacctaaacgattccttgcttagaccggcgagagaaaaaaatttcccaaacaatggaatagaaagtttggtggataagatgagtagatggaagacttatgctcaggatcacagagacgagcctgggatcatggggactacaagtagagcgagccgtagacgccagcgtcatgacagacagaggggtcttgtgtgggaagatgaggattcggccgatgatagcagcgtgttggacttgggtgggagaggaaggggcaacccgtttgctcatttgcgccctcgcttgggtggtatgttgtaaaaaaaaataaaaaggaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcaggcgacggcggtgatgcaatccccactggaggctccctttgtacctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagaccattaactttgatgaacgatcgcggtggggcggtcagctaaagaccatcatgcatactaacatgcccaacgtaaacgagtatatgtttagtaacaacttcaaagcgcgtgtgatggtgtccagaaaacctcccgaaggtgctgcagttggggatacatatgatcacaagcaggatattttggaatatgagtggtttgagtttactttgccagaaggcaacttttcagttactatgaccattgatttgatgaacaatgccatcatagataactacttgaaagtgggcagacagaatggagtgcttgaaagtgacattggtgttaagttcgacaccaggaacttcaagctgggatgggatcccgaaaccaagttgattatgcctggagtgtatacgtatgaagcctttcatcctgacattgtcttactgcctggctgtggagtggactttaccgaaagtcgtttgagcaaccttcttggtatcagaaaaaaacagccatttcaagagggttttaagattttgtatgaagatttagaaggaggtaatattccggccctcttggatgtagatgcctatgagaacagtaagaaagaacaaaaagccaaaatagaagctgctgcggaagctaaggcaaacatagttgccagcgactctacaagggttgctaacgctggagaggtcagaggagacaattttgcaccaacacctgttccgactgcagaatcattattggccgatgtatctggaggaacggacgtgaaactcactattcaacctgtagaaaaagatagtaagaatagaagctataatgtgttggaagataaaatcaacacagcctatcgcagttggtacctttcgtacaattatggcgatcccgaaaaaggagtgcgttcctggacattgctcaccacctcagatgtcacctgcggagcagagcaggtctactggtcgcttccagacatgatgcaggatcctgtcactttccgctccactagacaagtcagcaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaatgtccattcttatctcgcccagtaataacaccggttggggtctgcgcgctccaagcaagatgtacggaggcgcacgcaaacgttctacccaacatcccgtgcgtgttcgcggtcattttcgcgctccatggggtgccctcaagggccgcactcgcgttcgaaccaccgtcgatgatgtaatcgatgaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtgggacgaagagccatgcttagggcggccagacgtgcagcttcgggcgccagcgccggcaggtcccgcaggcaagcagccgctgtcgcagcggcgactattgccgacatggcccaaacgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgctgaaggatgaaaaaaaaccccgcaaaatcaagcgggctaaaaaggacaaaaaagaagaggaagatggcgatgatgggctggcggagtttgtgcgcgagtttgccccacggcgacgcgtgcaatggcgtggacgcaaagttcgacatttgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactaatggtacccaaacgccaaaagttggaggacgttttggagaaagtaaaagtggatccagatattcaacctgaggttaaagtgagacccattaagcaggtagcgcctggtctgggagtacaaactgtagacattaagattcccactgaaagtatggaagtgcaaactgaacccgcaaagcctactgccacctccactgaagtgcaaacggatccatggatgccgatgcctattacaactgacgccgccggtcccactcgaagatcccgacgaaagtacggtccagcaagtctgttgatgcccaactatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatagtagtgcggaacctttgacactgccgcgtgcgcgttaccatccaagtatcatcacttaatcaatgttgccgctgcctccttgcagatatggccctcacttgtcgccttcgcgttcccatcactggttaccgaggaagaaattcgcgccgtagaagagggatgttggggcgcggaatgcgacgctacaggcgacggcgtgctatccgcaagcaattgcggggtggttttttgccagccttaattccaattatcgctgctgcaattggcgcgataccaggcatagcttccgtggcggttcaggcctcgcaacgacattgacattggaaaaaaaaaagtataaataaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaactttgaacaaaaagtagtcgatgggatagcttccggcatcaatggagtggtagatttggctaatcaggctgtgcagaaaaagataaacagtcgtttggacccgccgccagcaaccccaggtgaaatgcaagtggaggaagaaattcctccgccagaaaaacaaggcgacaagcgtccgcgtcccgatttggaagagacgctggtgacgcgcgtagatgaaccgccttcttatgaggaagcaacgaagcttggaatgcccaccactagaccgatagcccctatggctaccggggtgatgaaaccttctcagttgcatcgacccgtcactttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcattgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccagtgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgatcgtagccagcggctcatgttgcgcttcgtgcccgttgaccgggaggacaatacatactcttacaaagtgcggtacacactggccgtgggcgacaacagagtgctggatatggccagcacgttctttgacattaggggcgtgttggacagaggtcccagtttcaaaccctattctggtacggcttacaactctctggctcctaaaggcgctccaaatacatctcagtggattgcagaaggtgtaaaaaatggtgaggagcgcgtaacagaagaggaaaacaatactactacttacacttttggcaatgctcccgtaaaagctgaagctgaaattacaaaagaaggactcccaataggtttgaaagtttcagatgaagaaagtaaaccgatttatgctgataaaacatatcagccagaacctcagctgggagatgaaacttggactgaccttgatggaaagaccgaaaagtatgggggcagggctctcaaaccagatactaaaatgaaaccatgctacgggtcctttgccaaacctactactgtgaaaggcggtcaggcaaaaccaaaaacaacggagcagccaaatcagaaagtcgaatatgatattgacatggagttttttgatgcggcatcacagaaaacaaacttaagtcctaaaattgtcatgtatgcagaaaatgtaaatttggaaactccagacactcatgtagtgtacaaacctgaatcagaagacacaagttccgaagctaatttgggacaacagtctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttccaaactattgttttccactgaatggcataggggttccaacaaccagttacaaatcaatagtttcaaatggagacaatgcacctaattggaaggaacctgaagtaaatggaacaagtgagatcagacagggtaatttgtctgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggcgccaggtggtctctggatgctatggacaatgtcaacccattcaaccaccaccgtaacgctggcttgcgttaccgatccatgcttctgggtaacggacgttatgtgcctttccacatacaagtgcctcaaaaattcttcgctgtcaaaaacctgctgcttctcccaggctcctacacttatgagtggaacttcagaaaggatgtgaacatggtgctacagagttcccttggtaacgacctacgggtagatggcgccagcatcagtttcacgagcatcaacctctatgctacctttttccccatggctcacaacaccgcttccacccttgaagccatgctgcggaatgacaccaatgatcagtcattcaacgactacctatctgcagctaacatgctctatcccattcctgccaatgcaaccaatattcccatttccattccttctcgcaactgggcggctttcagaggctggtcatttaccagactcaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcccaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaacatgctttatgccaactcagctcatgctctggacatgacctttgaggtggatcccatggatgagcccaccctgctttatcttctcttcgaagttttcgacgtggtcagagtgcatcagccacatcgcggcatcatcgagacagtctacctgcgtacaccgttctcggccggtaacgctaccacgtaaaaagcttcttgcttcttgcaaacagcagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaacacggccggacgtgagacggggggagagcactggttggctttcggttggaacccacgttctaacacctgctacctttttgatccttttggattctcggatgatcgtcttaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctgactggagtgccaaacaacatgcttcattctcctaaagtccagcccaccctgtgtgacaatcaaaaagcactctaccattttctcaatacccattcgccttattttcgctcccatcgtacacacatcgaaagggccactgcgttcgaccgtatggatgtgcaataatgactcatgtaaacaacgtgttgaataaacagcactttattttttacatgtatcaaggctctggattacttatttatttacaagtcgaatgggttctgacgagaatcagaatgacccgcgggcagtgatacgttgcggaactgatacttgggttgccacttgaattcgggaatcaccaacttgggaaccggtatatcgggtaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggattagtatcatcttggcctgatcctgtctgattcctggatacacggctctcatgaaagcatcatattgcttgaaagcctgctgggctttactaccctcggtatagaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccattctcgctggccacatccatctcgataatctgctccttctgaatcataatagtgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggacgcctcggtgctcctcgtttacgtactggtgacagatgcgcttgtattgttcgtgctgctcaggcattagtttaaaagaggttctaagttcgttatccagcctgtacttctccataagtacacacatcacttccatgcccttctcccaagcagacaccaggggcaagctaatcggattcttaacagtacaggcagcagctcctttagccagaggatcatctttggcaatcttttcaatgcttcttttgccatccttctcaacgatgcgcacgggcgggtagctgaaacctactgctacaagctgcgcctcttctctttcttcttcgctgtcttgactgatgtcttgcatgggaacatgtttggtcttccttggcttctttttggggggtatcgggggaggaggactgtcgctccgttccggagacagggaggattgtgaagtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacaagtgccatcacatctcgtcgtcagcgacgaggaaaaggagcagagcttaaccattccaccgcccagtcctgccaccacctctaccctagaagataaggaggtcgacgcatctcatgacatgcagaataaaaaagcgaaagagtctgaaacagacatcgagcaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtggaagagctcagccgcgcctacgagcttaaccttttttcacctcgtactccccccaaacgccagccaaacggcacctgcgagccaaatcctcgcttaaacttttatccagcttttgctgtgccagaagtactggctacttatcacatcttttttaaaaatcaaaaaattccagtctcctgccgcgctaatcgcacccgcgctgacgccctacttaatctgggacctggttcacgcttacctgatatagcttccttggaagaggttccaaaaatcttcgagggtctgggcaataatgagactcgggccgcaaatgctctgcaaaagggagaaaatggcatggatgagcatcacagcgttctggtggaattggagggcgataatgccagactcgcagtactcaagcgaagcgtcgaggtcacacactttgcataccccgctgtcaacctgccccctaaagtcatgacggcggtcatggaccagttactcattaagcgcgcaagtcccctttcagaagacatgcatgacccagacgcctgtgatgagggtaaaccagtggtcagtgatgagcagctaacccgatggctgggcaccgactctccccgggatttggaagagcgtcgcaagcttatgatggccgtagtgctggttaccgtagaactagagtgtctccggcgtttctttaccgattcagaaaccttgcgcaaactcgaagagaatctgcactacacttttagacacggctttgtgcggcaggcgtgcaagatatctaacgtggaactcaccaacctggtttcctacatgggtattctgcatgagaatcgtctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttaacaagctcttacagaaatctcttaaggttctgtggacagggttcgacgagcgcaccgtcgcttccgacctggcagacctcatcttcccagagcgtcttagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaactgcaaggccccagcagccaaggcgatgggtcttctcctgggcaaagtttaaaactgaccccgggactgtggacctctgcctacttgcgcaagtttgccccggaagattaccacccctatgaaatcaagttctatgaggaccaatcacagcctccaaaggccgaactttcggcctgcgtcatcacccagggggcaattctagcccaattgcaagccatccaaaaatcccgccaagaatttctactaaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggacagtctggaggacagtctggaggaagacagtttggaggaggaaaacgaggaggcagaggaggtggaagaagtaaccgccggcaaacagttatccccggctgcggagacaagcaacagcgctatcatctccgctccgagtcgaggaacgcggcggcgtcccagcagtagatgggacgagaccggacgcttcccaaacccaaccaccgcttccaaaaccggtaagaaggatcggcagggatacaagtcctggcgggggcataagaatgccatcatctcctgcttgcatgagtgcgggggaaacatatccttcacgcgacgctacttgctattccaccatggggtgaactttccgcgcaatgttttgcattactaccgtcacctccacagcccctactatagccagcaaatcccggcagtctcgacagaaaaagacagcggcggcgacctccaacagaaaaccagcagcggcagttaaaaaatacacaacaagtgcagcaacaggaggattaaagattacagccaacgagccagcgcaaacccgagagctaagaaatcggatctttccaaccctgtatgccatcttccagcagagtcggggccaagagcaggaactgaaaataaaaaaccgatctttgcgttcgctcaccagaagttgtttgtatcacaagagcgaagatcaacttcagcgcactcttgaggacgccgaggctctcttcaacaagtactgcgcgctgactcttaaagagtaggcagcgaccgcgcttattcaaaaaaggcgggaattacatcatcctcgtcatgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatccccgaaattggcctgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctggtaatcagaggcagaggtatccagctcaacgacgagtcggtgagctctccgcttggtctacgaccagacggaatctttcaaattgccggctgcgggagatcttccttcacccctcgtcagactgttttgactttggaaagttcgtcttcgcaaccccgctcgggcggaatcgggaccgttcaatttgtggaggagtttactccctctgtctactttaaccctttctccggatctcctgggcactacccggacgagttcataccgaacttcgacgcaattagcgagtcagtggacggctacgattgatgtctggtgacgcggctgagctatctcggctgcgacatttagaccactgccgccgctttcgctgctttgcccgggaactcattgagttcatttacttcgaactccccaaggatcaccctcaaggtccggcccacggagtgcggattactatcgaaggcaaaatagactctcgcctgcatcgaattttctcccagcggcccgtgctgatcgagcgagaccagggaaacaccacggtttccatctactgcatttgtaatcacccaggattgcatgaaagcctttgctgtcttatgtgtactgagtttaataaaaactgaattaagactctcctacggactgccgcttcttcaacccggattttacaaccagaagaacgaaacttttcctctcgtccaggactctgttaacttcacctttcctactcacaaaccagaagctcaacgacaacaccgcttttccagaagcattttccctactaatactactttcaaaaccggaggtgagctccacagtctccccacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactagtcttgcttgttttactttcgcttttggaagcgggttctgccaattacgatccatgtctagactttgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttccccagtggtacactgtctctgtccgaggtcctgacggttccatccgcattagtaacaacactttcattttttctaaaatgtgcgatctggccatgttcatgagcaaacagtattctctatggcctcccagcaaggacaacattgtaacgttctccattgcttattgcttgtgcgcttgccttcttactgctttactgtgcgtatgcatacacctgcttgtaaccactcgtatcaaaaacgccaataacaaagaaaaaatgccttaacctctttctgtttacagacatggcttttcttacagctctcatacttgtcagcattgtcactgccgctcacggacaaacagtcgtctctatccctctaggtcataattacactctcataggacccccaatcacttcagaggtcatttggaccaaactgggaagcgttgattactttgatataatctgtaacaaaacaaaaccaataatagtaacctgcaacatacaaaatcttacattaattaatgttagcaaagtttacagcggttactattatggttatgacagatacagtagtcaatatagaaattacttggttcgtgttacccagtccaaaaccacgaaaatgccaaatatggcagaaattcgatccgatgacaattctctagaaacttttacatcttccaccacacctgacgaaaaaaatatcccagattcaatgattgcaattatcgcagcggtggcagtggtgatggcactaccagtaatatgcatgcttttatatgcttgtcgctacaagaagtttcatcctaaaaaacaagatctcctactaaggcttaacatttaatttctttttacacagccatggtttccactaccacattccttatgcttactagtatagcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatccaccactccagcaccccgcaaaactactttctctagcagcagtgccgctaacaatacaatttccaatccaacctttaccgcgcttttaaaacgcactgtgaataattctacaacaatttccacttcaacaatcagcatcatcgctgtcgtgacaattggaatatctattcttgtttttaccataacctactacacctgctgctataaaaaagacgaacataaaggtgatccattacttagatttgatatttaatttgttctttttttttttatttacagtatggtgaacaccaatcatggtacctagaaatttcttcttcaccatactcatctgtgcttttaatgtttgcgctactttcacagcagtagccacagcaagcccagactgtataggagcatttgcttcctatgcactgtttgcttttgtcacttgcatctgcgtatgtagcatagtctgcctggttattaattttttccaacttctagactggatccttgtgcgaattgcctacctgcgccaccatcccgaataccgcaaccaaaatatcgcggcacttcttagacttatctaaaaccatgcaggctatactaccaatatttttgcttctattgcttccctacgctgtctcaaccccagctacctatagtactccaccagaacaccttagaaaatgcaaattccaacaaccgtggtcatttcttgcttgctatcgagaaaaatctgaaattcccccaactttaataatgattgctggaataattaatgtaatctgttgcaccataatttcatttctaatctaccccctatttgattttggctggaacgctcccaatgcacatgatcatccccaagacccagaggaacacattcccctacataacatgcaacaaccaatagcgctaatagaatacgaaagtgaaccacaacccccactactccctgctattagttacttcaacctaaccggcggagatgactgaaacactcaccacctccaattccgccgaggatctgcttgatatggacggccgcgtctcagaacagcgactcgcccaactacgcatccgccagcagcaggaacgcgtggccaaagagctcagagatgtcatccaaattcaccaatgcaaaaaaggcatattctgtttggtaaaacaagccaaaatatcctacgagatcaccgctaccaaccatcgcctctcttacgagcttggcccccaacgacaaaaatttacctgcatggtgggaatcaaccccatagttatcacccaacaaagtggagatactaagggttgcattcactgctcctgcgaatccattgagtgcacctacaccctgctgaagaccctatgcggactaagagacctgctacccatgaattaaaaaaatgattaataaaaaatcacttacttgaaatcagcaataaggtctctattgaaattttctcccagcagcacctcacttccctcttcccaactctggtattctaaaccccgttcagcggcatactttctccatactttaaaggggatgtcaaattttagctcctctcctgtacccacaatcttcatctctttcttcccagatgaccaagagagtccggctcagtgactccttcaaccctgtctacccctatgaagatgaaagcacctcccaacacccctttataaacccagggtttatttccccaaatggcttcacccaaagcccagacggagttcttactttaaaatgtttaaccccgctaacaaccacaggcgggtctctacagctaaaagtgggagggggacttacagtagatgacactgatgggaccttacaagaaaacataggtaccaccacaccacttgttaagactgggcactctataggtttatccctaggagccggattgggaacagatgaaaataaactttgtaccaaattgggaaaaggacttacattcaattcaaacaacatttgcattgatgacaatattaacaccctgtggacaggaattaaccccaccgaagccaactgtcaaatgatggactccagtgaatctaatgattgcaaattaattctaacactagttaaaactggagccctagtcactgcatttgtttatgttataggagtatctaacaattttaatatgctaactacatacagaaatataaattttactgcggagctgttttttgattctgcgggtaatttactaactagcctgtcatccctaaaaactccacttaatcataaatcaggacaaaacatggctactggtgccattactaatgctaaaagtttcatgcccagcacaactgcttatcctttcaataataattctagagaaaaagaaaactacatttacggaacctgtcactacacagctagtgatcacactgcttttcccattgacatatctgtcatgcttaaccaaagagcaataagagctgatacatcatattgtattcgtataacttggtcctggaacacaggagatgccccagaggggcaaacctctgctacaaccctagttacctccccatttaccttttactacatcagagaagacgactgacaaataaagtttaacttgtttatttgaaaatcaattcacaaacttcgagtagttattttgcctcccccttcccatttaacagaatataccaatctctccccacgcacagctttaaacatttggataccattagagatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacgggatcgggcgattgtgtctcatcaaacccacaagcagccgctgtctgcgtcgctccgtgcgactgctgtttatgggatcgggatccacagtgtcctgaagcatgattttaatagcccttaacattaactttctggtgcgatgcgcgcagcaacgcattcttatttcacttagattaatacagtaggtacagcacattattacaatattgtttaataaaccataattaaaagcactccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcagcccaatataaccttccggaaccacactgccaacaccgctcccccagccatgcattgaagtgaaccctgctgattacaatgacaatgaagaatccaattctctcgaccatgaatcacttgagaatgaaaaatatctatagtagcacaacatagacataaatgcatgcatcttctcataatttttaactcctcaggatttagaaacatatcccaaggaataggaagctcttgcagaacagtaaagctggcagaacaaggaagaccacgaacacaacttacactatg

SEQ ID NO: 1450 - DNA, 32767 bp, Human adenovirus 54
catcatcaataatataccccacaaagtaaacaaaagttaatatgcaaatgagcttttaaattttaacggttttagggcagggccaatgttaattggttaacaagcggtaatgcagttgacgtcaagacgcacggccggcggttgccgcagaggcgtggcctagcccggaagcaagtcgcagggccgatgacgtataaaaaagcggactttaaacccggaaacggccgattttcccacggccacgcccggatatgaggtaattttgggcggttgcaagtaaaattaggacatggtggcgccaaaactgaatgaggaagtgaaaagcgaaaaataccggtcccgcccagggcggaatatttaccgagggccaacagactttgaccgattacgtggggtttcgattacggtgtttttttcgccaatttccgcgtccgtgttaaatccggtgtttatgttacacatcagctgatccacagggtatttaaaccagttaagtccgtcaagagactactcttgagtgccagcgagtagagttttctctaaactgtgctcccaaagtttaagaaaaatgagacacctgcacctcctgtcttcaactgtgcctattgacatggccgcattattgctggaggactatgtaaatacaatattggaggacgaactgcatttatctccgtttgagctgggacccacacttcaggacctatatgatttggaggtaaatgcccaggagaacgacccaaacgaagaggctgtgaatttaatatttccagaatctatgattcttcaggctgacatagccagcgaagctgtacctacttcagtttatacaccgactctgccgcctatacctaaattggaagaggaggataagctagaccttcggtgttatgaggaaggttttcctcccagcgattcagaggacgaacggggtgagcagagcgtggctataatctcagactatgcgtgtgtggttgtggaaaatcattttgtgttggacaatcctgaggtgccagggcaaggctgtaaatcctgtcaatatcaccgggaacagaccggagacccaaatgcttcctgcgctctgtgttacatgaaaatgagcttcagctttatttacagtaagtggagtaaatgtaagagaggctaagtgcttaagacattactgtgctttgcttgaacagctgtactaagtgtggtttatttttgttactaggtccggtgtcagaggatgagtcatcacccttagaagaagaccacccgtctccccctgatcttacaaatgacacgcccctgcaagtgcgcaaacccaccccggttagaccgagtggcgagaggcgagcggctgtttacaaaattgaggatttgttgcaggacgtgggtgggaatgaacctttgaacctgagcttgaaacgccccaggaactaggcgcagctgtgcttagtcatgtgtaaataaagttgtacaataaaagtatgtgtgacgcatgcaaggtgtggtttatgactcatgggcggggcttagtcctatataagtggtaacacctgggcacttaggcacaaactttaggaagttcctaatggatgtgtggagtattcttggggaatttaacaagacacgccggcttgtggaggatagttcagacgggtgctccgggttttggagacactggtttggaactcctctatctcgcctggtgtacacagttaagaaggattatagcgaggaatttgaaaatctttttgccgactgttctggcctgctagattctttaaattttggccaccagtcccttttccaggaaagggtactccacagccttgatttttccagcccagggcgcactacagccggggttgcttttgtggtttttttggttgacaaatggagccaggacacccaactaagcaggggctacattctggactttgcagccatgcacctgtggagggcctggatgaggcagcggggacagagaatcttgaactactggcttttacagccagcagcgtcgggtcttcttcatctacacagacaaacatccatgttggaggaagaaatgagggaggccatggacgagaacccgaggagcggcctggaccctccgtcggaagaggagctggattaaatgaggtatccagcctgtacccagagcttagcaaggtgctgacatccatggccaggggagtgaagagggagaggagcgatgggggcaataccgggctgatgaccgagctaactgccagcctgatgaatcgcaagcgcccagagcgtattacctggcacgagctacagcaggagtgcagggatgagataggcctgatgcaggataaatatggcctggagcaaataaaaacccattggttgaacccagacgaggattgggaggaggccattaagaaatatgccaagatagccctgcgcccagattgcaagtacagggtgactaagaccgtgaatattaaacatgcctgctacatctcggggaacggggcagaggtggacatcgatactctggacaagtcagccttcaggtgttgcatgatgggaatgagagtaggagtaatgaatatgaattccatgatctttataaacataaagttcaatggagagaagtttaatggggtactgtttatggccaacagccacatgaccctgcatggttgcagtttttttggctttaacaatatgtgtgcagaggtctggggtgctgctaagattaggggatgtaagttttacggctgctggatgggcgtggttggaagacccaagagcgagatgtctgtaaagcagtgtgtgtttgaaaaatgctacctgggagtctgtaccgagggcaatgctagagtaagacactgctcttccctagaaacgggctgcttttgcctggtgaagggcacagcctcgattaagcataatgtggtaaagggctgcacggatgagcgcatgtacaacatgctgacctgcgactcgggggtctgccatatcctgaagaacatccatgtgacctcccaccccagaaaaaagtggccagtgtttgagaataacctgctgattaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcggtggcagacacaccaggatgcagccagtggccctggatgtgaccgaggagctgcgaccagaccacctggtgatggcctgtaccgggaccgagttcagctccagtggggaggacacagattagaggtaggtttaagtagtgggcgtggctaaggtaagtataaaggcgggtgtcttacaagggtctttttgcttttctgcagacatcatgaacgggaccggcggggccttcgaaggggggctttttagcccttatttgacaacccgcctgccgggatgggccggagttcgtcagaatgtgatgggatcaacggtggacgggcgcccagtgcttccagcaaattcctcgaccatgacctacgcgaccgtggggacgagctcgtcgcttgacagcaccgccgcagccgcggcagccgcagccgccatgacagcgacgagactggcctcgagctacatgcccagcagcggtagcagcccctccatccccagttccatcatcgccgaggagaaactgctggccctgctggctgagctggaagccctgagccgccagctgaccgccctgacccaggaggtgtccgagctccgcgaacagcagcagcagcaaaataaatgatttaataaacacaaattttgattcaaacagcaaagcatctttattatttattttttcgcgcgcggtaggccctggtccacctctcccgatcattaagagtgcggtggattttttccaggacccggtagaggtgggattggatgttgaggtacatgggcatgagcccgtcccgggggtggaggtagcaccactgcatggcctcgtgttctggggttgtgttgtagatgatccagtcatagcaggggcgctgggcgtggtgctggatgatgtccttaaggaggagactgatggccacggggagccccttggtgtaggtgttggcaaagcggttgagctgggagggatgcatgcggggggagatgatgtgtagtttggcctggatcttaaggttggcgatgttaccgcccagatcccgccgggggttcatgttgtgcaggaccaccaggacaatgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcttgggtgagatcatcataagacattttaatgaatttggggcggagggtgccagattgtgggacgatggttccctcgggccccggggcgaagttcccctcgcagatctgcatctcccaggctttcatctcggagggggggatcatgtccacctgcggggcgatgaaaaaaatggtttccggggcgggggtgatgagctgcgaggagagcaggtttcttaacagctgggacttgccgcacccggttgggccgtagatgaccccgatgacgggttgcaggtggtagttcaaggagatgcaactgccgtcgtcccggaggaggggggctacctggttaagcatgtctctgacttggaggttttcccgaacaagctcgctgaggaggcggtccccgcccagcgagagcagttcttgcagggaagcaaagttttttaggggcttaagcccgtcggccatgggcatcttggcgagggtctgcgagaggagctccaggcggtcccagagctcggtgacgtgctctacggcatctggatccagcagacttcctcgtttcgggggttgggacgactgcgactgtagggcacaagacgatgggcgtccagcgcggccagcgtcatgtccttccagggtctcagggtccgcgtgagggtggtctccgttacggtgaatgggtgggccccgggctgggcgcttgcaagtgtgcgcttcagactcatcctgctggtgctgaaacgggcacggtcttcgccctgcgcgtcggcaagatagcagttaaccatgagctggtagttcagggccttggcggcatggcccttggcgcggagcttgcccttggaaaagcgcccgcaggcgggacagaggagggattgcagggcgtacagtttgggcgcgagaaagaccgactcgggggcaaaggcgtccgctccgcagtgggcgcagacggtctcgcactcgacaagccaggtgagctcgggctgcttggggtcaaaaaccagttttcccccgttctttttgatgcgcttcttacctcgcgtctccataagtctgtgtccgcgctcggtgacaaacaggctgtcggtgtccccgtagacggacttgattggcctgtcctgcaggggcgtcccgcggtcctcctcgtaaagaaactcggaccactctgagacgaaggcgcgcgtccacgccaagacaaaggaggccacgtgcgaggggtagcggtcgttttccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcaagagcgggcataacctcggcactcaggttgtcagtttctagaaacgaggaggatttgatgttggcctgccctgccgcaatgctttttaggagactttcatccatttggtcagaaaagactatttttttattgtcaagcttggtggcaaaggagccatagagggcgttggagagaagcttggcgatggatctcatggtctgatttttgtcacggtcggcgcgctccttggccgcaatgttgagctggacatattcgcgcgcaacgcacttccattcgggaaaaacagtggtgcgctcgtcgggcacaatcctgacgcgccagcctcggttatgcagggtgaccaggtccacgctggtggccacctcgccgcgcaggggctcgttagtccagcagaggcgcccgcccttgcgcgagcaaaaaggtggtaacacatcaagcaaatgctcgtcaggggggtccgcatcgatggtaaagatgcccggacagagttccttgtcaaaataatcaatttttaaggatgcatcatccaaggccatttgccagttgcgggcggccagggctcgctcgcaggggttcaggggcggaccccagggcatgggatgcgtaagcgcggaggcgtacatgccgcagatgtcatacacatagatgggctccgagaggatgccgatgtaggtgggataacagcgccccccgcggatgctggcgcgcacgtagtcatacaactcatgcgagggtgccaagaaggcggggccaagattggtgcgctggggctgctcggcgcgaaagacgatctggcgaaagatggcatgcgagttggaggaaatagtgggccgttggaagatgttaaagtgggcgtggggcaggcggaccgagtcgcggataaagtgcgcgtaggagtcttgcagcttggcgaccagctcggcagtgacaaggacgtccatggcgcagtagtccagtgtttcgcggataatgtcataacccgcctctccttttttcttccacagctcgcggttaagggcgtactcctcgtcatccttccagtactcccggagcgggaatcctcgatcgtccgcacggtaagagcccagcatgtagaaatggttaacggccttgtagggacagcagcccttctccacggggagggcgtaagcttgagcggccttgcggagcgaggtgtgcgtcagggcaaaggtgtccctgaccatgactttcaaaaactggtacttaaagtccgagtcgtcgcagccgccgtgctcccagagctcaaaatcggtgcgcttctttgagagggggttaggcagagcgaaagtgacgtcattgaagagaatcttgcctgctcgtggcataaaattgcgggtgatgcggaaagggcccggaacgcaggctcggttgttgataacctgggcggctaggacaatctcgtcaaagccgttgatgttgtgcccgacaatgtatagttccatgaatcgcgggcggcctttgatgtgcggcagctttttaagctcctcgtaggtgaggtcctcggggcattgcaggccgtgctgctccagtgcccactcctgaagatgtgggttggcttgcatgaaggaaacccagagctcgcgggccataagggtctggagctcgtcgcgaaagaggcggaactgctggcccacggccatcttttcgggggtgatgcagtagaaggtaagggggtcccgctcccagcgatcccagcgtaagcgcacggcaagatcgcgagcaagggcgaccagcttggggtccccggagaatttcatgaccagcatgaaggggacaagctgcttgccgaaggaccccatccaggtgtaggtttctacatcgtaggtaacaaagagccgctccgtgcgaggatgagagccgattgggaagaactggatttcctgccaccagttggacgagtggctgttaatgtgatgaaagtagaaatctctccggcgaaccgagcactcgtgctgatgcttgtaaaagcgtccgcagtactcgcagcgctgcacgggctgtacctcatccacaagatacacagcgcgtcccttgaggaggaacttcaggagtggcggccctggctggtggttttcatgttcgcctgcgtaggacttaccctggggctcctcgaggacggagaggctgacaagcccgcgcgggagccaggtccaaatctcggcgcggcgggggcggagagcgaagacgagggcgcgcagttgggagctgtccatggtgttgcggagatccaggtccgggggcagggttttaaggttgacctcgtagaggcgggagagggcgtgcttaagatgcagatggtacttgatctccacgggtgagttggtggccgtgtccacgcattgcatgagcccgtagctgcgcggggccacgaccgtgccgcggtgcgcttttagaagcggtgtcgcggacgcgctcctggcggcagcggcggttccggccccgtgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctcggcgtcattgacggcggcctgccgcaggatctcttgcacgtcgcccgagttgtcctggtaggcgatctcggacatgaactgctcgatctcctcctcctggagatcgccgcggcccgcgcgctcgacggtggcggcaaggtcatttgagatgcgacccataagctgcgaaaaggcacccaggccgctctcgttccaaacgcggctgtaaaccacgtccccgtcaacgtcgcgcgcgcgcatgaccacctgcgcaaggttcagctccacgtgccgcgtaaagacggcgtagttgcgcaggcgctgaaaaaggtagttaagggtggtggcgatgtgctcggtgacaaagaagtacatgatccagcggcgcaggggcatttcgctgatgtcgccaatggcctccagcctttccatggcctcgtaaaagtccacggcaaagttaaaaaactgggcgttgcgggccgataccgtgagctcgtcttccaggagccggatgagctcggcaatggtggcgcgcacctcgcgctcaaaatccccgggagcctcctcttgttcctcttccatgacgacctcttcttctatttcctctgggggcggtggtggtggcggggcccgacgacgacggcgacgcaccgggagacggtcgacgaagcgctcgatcatttccccgcggcggcgacgcatggtttcggtgacggcgcgaccctgttcgcgaggacgcagcgtgaagacgccgccggtcatctcccggtaatagggcgggtccccgttgggtagcgaaagggcgctaacgatgcatcttatcaattgcggcgtaggggacgtaagcgcgtcaagatcgaccggatcggagaatctttggaggaaagcgtctagccaatcgcagtcgcaaggtaagcttaaacacgtagcagccctgtggacgctgttagaattgcgattgctgatgatgtaattgaagtaggcgtttttgaggcggcggatggtggcgaggaggaccaggtccttgggtcccgcttgctggatgcgaagccgctcggccatgccccaggcctgaccctgacaccggctcaggttcttgtagtagtcatgcatgagcctctcaatgtcatcatttgcggcggaggcggagtcttccatgcgggtaaccccaacgcccctgagcggctgcacgagcgccaggtcggcgacgacgcgctcggcaaggatggcctgttgcacgcgggtgagggtgtcttggaagtcgtccatgtcaacaaagcggtggtaggccccggtgttaatggtgtaggtgcagttggccataagcgaccagttaacggtctgcaggccgggctgcacaacctcggagtacctaagccgcgagaaggcgcgcgagtcaaagacgtagtcgttgcaggtgcgcacaaggtactggtatccaactaggaagtgcggcggcggctggcggtacagcggccagcgctgggtggccggcgcgcccggggccaggtcctcgagcatgaggcggtggtagccgtagaggtagcgggacatccaggtaatgccggcggcggtggtggaggcgcgcgggaactcgcggacgcggttccagatgttgcgcagcggtaggaaatagtccatggtcggcacggtctggccggtaagacgcgcgcagtcattgacgctctagaggcaaaaacgaaagcggttgagcaggctcttcctccgtagcctggcggaacgcaaacgggttaggccgcgcgtgtaccccggttcgagtcccctcgaatcaggctaaagccgcgactaacgtggtattggcactcccgtctcgacccaagcccgatagccgccaggatacggtgaagagccttttttgccggccgagaggggtcgctagatttaaaagcggtcgaaaaccccgccgggtagtggctcgcgcccgtagtctggagaagcattgccagggttacgtcgcggcagaacccggttcgcagacggccgcggcgagcgagcccccttttttcttttgccagatgcatcccgtcctgcgccaaatgcgtcccacccccccggcgaccaccgcaaccgcggccgtagcaggcgccggcgctgtacaacagcagacagagatggacttggaagagggcgaagggctggcaagactgggggcaccgtccccggagcgacacccccgcgtgcagctgcaaaaggacgtgcgcccggcgtacgtgcctgcgcagaacctgttcagggaccgcagtggggaggagcccgaggagatgcgcgactgccggtttcgggcgggcagggagctgcgcgagggcctggaccgccagcgcgtgctgcgcgacgatgatttcgagccgaacgagcagacggggatcagccccgcgcgcgcgcacgtggcggcggccaacctggtgacggcctacgagcagacggtgaaacaggagcgcaacttccaaaagagtttcaacaaccacgtgcgcaccctgattgcgcgcgaggaggtggccctgggcctgatgcacctatgggacctggcggaggccatcgtgcaaaacccggacagcaagcctctgacggcgcagctgttcctggtggtgcagcacagcagggacaacgaggcgtttagggaggcgctgctaaacattgccgagcccgagggtcgctggctgctggagctgattaacatcttgcagagcatcgtagtgcaggagcgcagcctgagcctggccgagaaggtggcggcgatcaactactcagtgctgagcctgggcaagttttacgcgcgcaagatttacaagacgccgtacgtgcccatagacaaagaggtgaagatagacagcttttacatgcgcatggcgctcaaggtgctgacgctgagcgacgacctgggcgtgtaccgcaacgaccgcatccacaaggccgtgagcacaagccggcggcgcgagctgagcgaccgcgagctgatgctgagcctgcgccgggcgctggtagggggcgccgccagcggcgaagagtcccactttgacatgggggcggacctgcattggcagccgagccggcgcgccttggaggccgcctacggtccagaggacttggatgaggatgaggaagaggaggaggatgcacccgctgcggggtactgacgcctccgtgatgtgtttttagatgtcccagcagcaagccccggaccccgccataagggcggcgctgcaaagccagccgtccggtctagcatcggacgactgggaggccgcgatgcaacgcattatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgcttaacgcctttttggcaacgcagccggcgaacgtgccgcgcgggcaggacgattacaccaattttatcagcgcgctgcggctgatggtgaccgaggtgccccagagcgaggtgtaccagtcgggcccggactactttttccagacaagccggcagggcctgcagacggtgaacctaagccaggctttcaagaacctacgcgggctgtggggcgtgcaggcgcccgtgggcgaccggtcaacggtgagcagcttgttgacgcccaactcgcggctgctgctgctgctgatcgcacccttcaccgacagcggcagcgtaaaccgcaactcgtacctgggccacctgctaacgctgtaccgcgaggccataggccaggcgcaggtggacgagcaaaccttccaggagatcacaagcgtaagccgtgcactggggcagaacgacaccgacagtttgagggccaccctaaacttcctgctgaccaatagacagcagaaaattccgccgcagtacgcactgtcggccgaggaagaaaggattctgagatatgtgcagcagagcgtagggctgttcctgatgcaggagggggccacccccagcgccgcgctggacatgaccgcgcgcaacatggaacctagcatgtacgccgccaaccggccgtttattaataagttgatggactacctgcaccgcgcggcgtccatgaactcggactactttaccaatgccatcttgaacccgcattggctcccgccgccagggttctacacgggcgagtacgacatgcccgaccccaacgacgggtttctgtgggacgacgtggacagcgcggtatttttgcccgcctttcaaaagagacaggaagcaatgcgcacgcctagcgagggcgctgtgggaaggagcccctttcctagcttaggaagtttgcatagcctacctaactcggtaaacagcggcagggtgagccggccgcatttgctgggcgaggacgagtacctgaacgactcgctgctgcggccgccgcgggccaagaacgccatggccaataacgggatagaaagtctggtggacaaactaaaccgctggaagacctacgctcaggatcatagggacgcgcccgcaccgcggcgacagcgccacgaccggcagcggggcctggtgtgggacgacgaggactcggccgacgatagcagcgtgttggacttgggcgggagcggtggtggggccaacccgttcgcgcatctgcagcccagactggggcaacggatgttttgaatgcataaaataaaactcaccaaggccatagcgtgcgttctcttccttgttagagatgaggcgcgcggtggtgtcctctcctcctccctcgtacgagagcgtgatggcgcaggcaaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcaccaccgccgaggccagcacgcagacgataaattttgacgagcggtcccggtggggcggtgatctgaagaccattctgcacaccaacatgcccaatgtgaacgagtacatgttcaccagcaagtttaaggcgcgggtgatggtggctaggaagcacccagaaggggtagacaacacagatttgagtcaggataagcttgaatatcagtggtttgagtttaccctgcccgagggcaatttttccgagaccatgaccatagacctgatgaacaacgccatcttggaaaactacttgcaagtggggcgtcaaaatggcgtgctggagagcgatattggagtcaagtttgacagcagaaatttcaagctgggctgggacccggtaactaagctggtgatgccgggggtctacacctacgaggccttccacccggacgtggtgctgctgccgggctgcggggtggacttcaccgagagccgcctgagcaacctcctgggcattcgcaagaagcaacctttccaagagggtttcaggatcatgtatgaggatctagaaggcggcaacatccccgcacttctaaatgtaaccaagtacttggaaagcaagaagacgctacagaaggcagtggaaaatgctgctaaagttaatgctcctgcaagaggagatagcagtgtcccaagagctgtagaaaaggctgctgagaaggagctagagattgttcccattgaaaaggatgacagcaacagaagttataatattatacctggaaccacggacaccctgtaccgcagttggtacctgtcctatacctacggggaccccaaaaagggggtacagtcgtggacgctgctcaccaccccggacgttacctgcggcgcggagcaagtttactggtcgctgccggacctcatgcaagaccccgtcacctttcgctccacccagcaagtcagcaactaccccgtggttggcgccgagctcatgcccttccgcgccaaaagcttttacaacgatctcgccgtctactcccagctcatccgcagctacacctccctcacccacgtcttcaaccgcttccccgacaaccagatcctgtgccgcccgcccgcgcccaccatcaccaccgttagtgaaaacgtgcctgctctcacagatcacgggacgctaccgctgcgcagcagtatccgcggagtccagcgagtgaccgttactgacgcccgtcgccgcacctgtccctacgtctacaaggccctgggcatagtcgcgccgcgcgtgctctccagtcgcaccttctagaaaatgtccattctcatctcgcccagcaataacaccggctggggtcttactaggcccagcaccatgtacggaggagccaagaagcgctcccaacagcaccccgttcgcgtccgcggccactttcgcgctccctggggcgcttacaagcgcgggcggacctctgcccccgccgccgtgcgcaccaccgtcgacgacgtcattgactccgtagtcgctgacgcgcgcaactacacccccgccccctccaccgtggacgcggtcattgacagcgtggtggctgacgcgcgcgactatgccagacgcaagagccggcggcgacggattgccaggcgccaccggagcacgcccgccatgcgcgccgcccgggctctgctgcgccgcgccagacgcactggccgccgggccatgatgcaagccgcgcgtcgcgccgccgccgcacccacccccacaggcaggactcgcagacgagcggccgttgccgccgccgcggccatctctagcatgaccagacccaggcgcggaaacgtgtactgggtgcgcgactccatcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggcggaccagaaaccccgcaaaatcaaacgggttaaaaaaaaggatgaggtgggcgagggggcagtagagtttgtgcgcgagtttgctccgcggcggcgcgtaaattggaaggggcgcagggtgcagcgcgtgttgcggcccggcacggcggtggtgtttacgcccggcgagcggtcctcggtcaggagcaagcgtagctatgacgaggtgtacggcgacaacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagaacatgtacccgaccatgcagatcatggtgcccaagcgtcggcgcgtggaggacgtgctggacaccgtgaaaatggatgtggagcccgaggttaaggtgcgccccattaagcaggtggcgccgggcctgggcgtgcagaccgtggacattcagatccccaccgacatggatgtcgacaaaaaaccctcgaccagcatcgaggtgcagaccgacccctggctcccagcctccaccgcctttacatccacggccaccgagccttccaggaggcgaagatggggccctgccaaccggctgatgcccaactacgtgttgcatccttccatcatcccgacgccgggctaccgcggcacccggtattacgccagccgcaggcgccccgcaggcaagcgccgccgccgcaccaccacccgccgccgtctggcccccgcccgcgtgcgccgcgtaactacgcgccagggccgctcgtttgttctgcccaccgtgcgctaccaccccagcatcctttaatccgtgtgctgtaatactgttgcagagagatggctctcacttgccgcctgcgcattcccgtcccgaattaccgaggaagatcccgccgcaggagaggcatggcaggcagcggcctaaaccgccgccggcggcgggccatgcgcaggcgcctgagtggcgggttcctgcctgcgcttatccccataatcgccgcggccattggcacgatcccgggcatagcttccgttgcgctgcaagcgtcgcagcgccgttaatgtgcaaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaattttggctcaacgctccggacctatgggaacaaggcctggaatagtagcacagggcaaatgttaagggaaaagctcgcagaccagaacttccagcaaaaggtggtggacggcctggcctcaggcattaacggggtagtggacattgcaaaccaggccgtgcagcgcgagataaacagccgcctgaacccgcggccgcccacggtggtggagatggaagatgcaactcctccgcccaggggcgagaagcggccgcggcctgacgcggaggagacgaccctgcaggtagacgagccgccctcgtacgaggaggcccttaaggccggcatgcccaccacacgcatcattgcgccaatggccacgggtgtcatgaaacccgccacccttgacctgccttcaccacccgtgcccgctccaccaaaggcagctccggtcgtgcaggcccccccggtggcaaccgccgtgcgccgcgtccccgcccgccgccaggcccagaactggcagagcacgctgcacagtatcgtgggcctgggagtgaaaagtctgaagcgccgccgatgctattaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttagaaaccccacggtggctcccacccacgatgtgaccacggaccggtcccagcgtctgacgctgcgctttgtgcccgtggatcgcgaggacaccacgtactcgtacaaggcgcgcttcactctggccgtgggcgacaaccgggtgctagacatggccagcacgtactttgacatccgcggcgttttggaccgcggtcccagctttaaaccctactcgggcacggcttacaacagtttggcccccaagggcgccccaaactccagtcagtggattacaaaacaaactaatgctggaaacgaaactacaaaaactcacacatacggtgtcgctgccatgggaggcgctgacataacaattaagggtctgcaaattggtgttgacaaaactgaaaacaaaaatgagcctatctatgcaaacgaaatctatcagccagaacctcaagtaggagaagaaaacctgcaagatgttgaaaattactatggaggcagagcccttaaaaaggaaaccaaaatgaagccttgttatggctcatttgctagacccacaaatgaaaaaggagggcaggctgtatttaaaactggaaatgatggccagccaactactgagcatgacataacaatggctttctttgatactcctggcgacactaatgctgaagacacagaacttgaagcagacattgttatgtacaccgaaaatgttaatcttgaaactccagatactcatgtggtgtacaagccaggacctttagaagacagttcagaaattaatttaacacagcagtccatgccaaacaggccaaactacattggcttcagggacaactttgtaggccttatgtactacaacagcactggcaacatgggtgtgctagctggtcaggcctctcagttgaatgctgtggttgacttacaagacagaaacacggagctgtcttaccagcttttgctagattctctgggtgacagaaccagatactttagtatgtggaactctgcggtggacagttacgatccagatgtcaggattattgagaatcacggtgtggaagatgaacttccaaactattgctttccattggacggagctggtactaatgctacatatcagggtgttaaagttaaaaatggacaggatggtgacaacaacgcagaatgggagaaagacaatgcagttgcggatcgaaaccaaatttgcaagggtaacatcgtcgccatggaaattaaccttcaggccaacctgtggaaaagttttctgtactcgaacgtggccttgtacctgcccgactcctttaagtacacgccggccaacgtcacactgcccaccaacaccaacacctacgagtacatgaacgggcgcgtggtggccccctcgctggtggacgcttacgttaacattggcgcccgctggtcactggaccccatggacaacgttaacccctttaaccaccaccgcaacgcgggcctgcgctatcgctccatgctgctgggcaacgggcgctacgtgccctttcacatccaagtgccccaaaagttctttgccattaaaaacctgctcctgctcccgggctcctacacctacgagtggaacttccgcaaggacgtcaacatgatcctgcagagttccctgggcaacgacctgcgcgtcgacggcgcctccgtccgctttgacagtgtgaacctctacgccaccttcttccccatggcgcacaacaccgcctccaccctggaagccatgctgcgcaacgacaccaacgaccagtccttcaacgactacctctcggccgccaacatgctttaccccatcccggccaaggccaccaacgtgcccatttccatcccctcgcgcaactgggccgcctttcgcggctggagttttacccgcctaaaaaccaaggaaactccctcactcggctcgggtttcgacccctactttgtctactcaggctccatcccctaccttgacgggaccttctacctcaaccacaccttcaagaaggtctccattatgttcgactcctcggttagctggcccggcaatgaccggctgcttacgccgaacgagttcgagattaagcgcagcgtcgacggggagggctataacgtggcccaatgcaacatgaccaaggactggttccttatccagatgctttcccactacaacattggctaccagggcttccacgtgcctgagggctacaaggaccgcatgtactccttcttccgcaacttccagcccatgagtaggcaggtggtcgatgagattaactacaaggattacaaggccgttgccctgcccttccagcacaacaactcgggcttcaccggctacctcgcacctaccatgcgccaggggcagccctaccccgccaacttcccctacccgcttattggagagaccgccgtgccctccgtcacccaaaaaaagttcctctgcgacagggtcatgtggcgcatcccattctccagcaacttcatgtctatgggcgcccttaccgacctgggtcaaaacatgctttacgccaactcggcgcacgcgctcgacatgacctttgaggtggaccccatggatgagcccaccctcctctatcttctctttgaagttttcgacgtggtcagagtgcaccagccgcaccgcggcgtcatcgaggccgtctacctgcgcacgcccttctccgccggcaacgccaccacctaagcatgagcggctccagcgaacaagagctcgcggccattgtgcgcgacctgggctgcgggccctactttttgggcacccacgacaagcgcttcccgggcttcctcgccggcaacaagctggcatgcgccatcgtcaacacggccggccgcgagaccgggggcgtgcactggcttgcctttggctggaacccgcgctcgcgcacctgctacatgtttgacccctttgggttttcggaccgccggcttaagcagatttacagcttcgagtacgaggccatgttgcgtcgcagcgccctggccttatcgcccgaccgctgtctcagcctcgagcagtccacccagaccgtgcaggggcccgactccgccgcctgcggactcttctgttgcatgttcttgcatgccttcgtgcactggcccgatcgacccatggacgggaaccccaccatgaacttgctaacgggggtgcccaatggcatgctacaatcgccacaggtgctgcccaccctccggcgcaaccaggaggagctctaccgcttccttgcgcaccactccccctactttcgctcccaccgcgccgccattgaacacgccaccgcttttgataaaatgaaacaactgcgtgtatgactcaaataaacagcacttttattttacatgcactggagtatatgcaagttatttaaaagtcaaaggggttctcgcgctcgtcgttgtgcgccgcgctgggaagggccacgttgcggtactggtacttgggctgccacttaaactcggggatcaccagtttgggaacagcaatctcggggaaggtctcgctccacatgcgccggctcatctgcagggcgcccagcatgtccggggctgaaattttaaaatcgcagttgggaccggtgctctgcgcgcgcgagttgcggtacacggggttgcagcactgaaacaccatcaaactggggtactttacgctggccagcacgctcttatcgctaatctgatccttgtccaggtcctcggcgttgctcaggccgaacggggtcatcttacacagctggcggcccaggaagggcacgctgtggggcttgtggttacactcgcagtgcacgggcattagcatcatccctgcgccgcgctgcatattcgggtacagggccttaataaaggccataatctgcttaaaagcttgctgggccttggctccctcgctaaaaaacaggccgcagcttttcccgctaaactggttattcccgcacccggcatcctgcacgcagcagcgcgcgtcatggctggtcagttgcaccacgcttctcccccagcggttctgggtcactttggccttgctgggttgctccttcaacgcgcgctgaccgttctcgctggtcacatccatctccaccacatggtccttgtggatcattaccgtcccgtgcagacacttgagctggccttccacctcggcacagccgtggtcccacagggcactgccggtgcactcccagtttttgtgcgcgatcccgctgtggctaaagatgtaaccttgcaacaggcgacccattacggtgctaaagctcttctgggtggtaaaggtcagttgcatcccgcgggcctcctcgtttatccaggtctggcacattttttggaagatctcggtctgctcgggcataagcttgtaagcatcgcgcaggccgctgtcaacgcggtagcgttccatcagcacgttcatggtatccatgcccttctcccaggacgaaaccaaaggcagactcagggggttgcacacgttcagaataccgggggtcgcgggctggacaatgcgttttccgtccttgccttccttcaacagaaccggcggctggctgaatcccactcccacgatcacggcatcttcctggggcatctcttcgtcggggtttaccttggtcacatgtttggtctttctgggctgcttcttttttggagggctgtccagtggaaccacgtcctcctcggaagacccggagcccacccgctgatactttcggcgcttggtgggcagaggaggtagcggcggcgaggggctcctttcctgctccggcggatagcgcgccgacccgtggccccggggcggagtggcctctcggtccataaaccggcgcacgtcctgactgccgccggccattgtttcctaggggaagatggaggagcagccgcgtaagcaggagcaggaggaggagaacttaaccacccacgagcaacccaaaatcaagcaggacctgggcttggaagagccggctcgtctagaacccccacaggatgaacagaaggaaaccaacgctgggctggagcatggctacctgggaggacaggaggatgtgctgctaaaacacttgcagcgccagtcctttatcctccgggacgctctggccgaccgaagcaaaacccccctcagcgtccaggagctgtgtcgggcctatgagctcaacctcttctcgccgcgcgtgccccccaaacgccagcccaacggcacctgcgagcccaacccgcgtcttaacttttaccccgtctttgcagtccccgaggcccttgccacttatcacatcttttttaagaaccaaaagatccccgtttcctgccgtgccaaccgcacccgcgccgacgcgctcctcgctctggggcccggcgcgcgcatacctgatattgcttccctggaagaggtgcccaagatcttcgaagggcttggtcgggacgagacgcgcgcggcgaacgctctgaaagaaacagcagaggaacagggttacactagcgccctggtagagttggaaggcgataacgccaggctggccgtgcttaagcgcagcgtcgagctcacccattttgcctaccccgccgttaacctcccgcccaaggtcatgcgtcgcatcatggatcagctcatcatgccccacattgaggcccttgatgaaagccaaaagcagcgccctgaggacgcccagcccgtggttagcgacgaaatgcttgcgcgctggctcggaaaccgcgacccccagtccctggagcagcggcgtaagctcatgctggccgtggtcctggtcaccctcgagttggaatgtatgcgccgcttttttagcgaccccgagaccctgcgcaaggtcgaggagaccctgcactacacttttaggcacggctttgtcaggcaggcctgcaagatctccaacgtggagctaaccaacctggtctcctgcctggggatcctacacgagaaccgcctggggcagactgtgcttcactcgaccctcaagggcgaggcacggcgggactacatccgcgactgcgtctttctttttctctgccacacctggcagtcggccatgggcgtgtggcagcagtgtctcgaggacgagaacctgaaggagctggacaagcttcttgctaaaaaccttaaaacgttgtggacgggctttgacgagcgcaccgtcgccttggacctggccgaaattgtttttcccgaacgcctaaggcagacgctaaaaggcgggctgcccgactttatgagccagagcatgttgcaaaactaccgcactttcattctcgagcgatcggggatcctgcccgccacctgcaacgccttcccctccgactttgtcccgctgagctaccgcgagtgtcccccgccgctgtggagccactgctacctcttgcagctggccaactacattgcctaccactcggacgtgatcgaggacgtaagcggcgaggggctgcttgagtgccactgccgctgcaacctgtgctccccgcaccgctccctggtctgcaacccccagctcctgagcgagacccaggtcatcggtaccttcgagctgcaaggtccggagaagtccaccgctccgctgaaacttacgccggggttgtggacttccgcgtacctgcgcaaatttgtaccccaggactaccacgcccacgaaataaagttctttgaggaccaattgcgcccgcagcacgcggatcttacggcctgcgtcatcacccagggcacgatcctcgcccaattgcacgccatccaaaaatcccgccaagagtttcttctgaaaaagggtaaaggggtctacctggacccccagacgggcgaagtgcttaacccgggtctcccccagcatgccaagaaagaagcaggagccactagtggaggagatggaagaagaatgggacagccaggcagaggaggacgaatgggaggaggaagaattggaagaggtggaacaggagcaggcaacagagcagcccgtcgccgcaccatccgcgccggcagcccctccggtcaagcctcctcgtagatgggatcgagtaaagggtgacggtaagcaccagcggcagggctaccgatcatggagggcccacaaagccgcgattattgcctgcttgcaagactgcggggggaacatcgcttttgcccgccgctacctgcttttccaccgcggggtaaacatcccccgcaacgtgttgcattactaccgtcaccttcacagctaacaaaaagcaagtaaaagaagtcgccggaggaggaggcctgaggattgcggcggacgagcccttgaccaccagggagctaaggaaccgaatcttccccactctttatgccatttttcagcagagtcgaggtcagcagcaagagcttaaagtaaaaaatcggtctctgcgctcgctcacccgcagttgcttgtaccacaaaaacgaagatcagctgcagcgcactcttgaagacgccgaggctttgttccacaagtactgcgcgcttactcttaaagactaaggcgcgcccacccggaaaaaaggcgggaattacctcatcgccagcaccatgagcaaggagattcccacaccttacatgtggagctatcagccccagatgggcctagccgcgggcgcctcccaggactactccacccgcatgaactggcttagtgccgggccctcgatgatctcacaagtcaacgggatccgtaaccatcgaaaccagatattgttggagcaggcggcggtcacctccacgcccagggcaaagcttaacccgcgtaattggccctccaccctggtgtatcagaaaatccccgggccaactaccgtactacttccgcgtgacgcactggccgaagtccgcatgactaactcaggtgtccagctggcgggcggcgcttcccggtgtccgcccagacccgacttaggtataaaaacactgctgatccgaggcaaaggcatacaacttaacaacgagttggtgagctcttccattggtctgcgacccgacggagtgtttcaactagccggagccgggaaatcgtccttcactcccaaccaggcctacctgaccttgcagagcagctcttcgcagcctcgctccggaggcattggaactctccagttcgtggaggagtttgtgccctcggtttactttaaccccttttcaggctccccaggcctctaccccgacgagttcataccgaacttcgacgcagttagagaagcggtcgacggctacgactgaatgtcctatggtgactcggctgagcttgctcggttaaggcatctggaccactgccgccgcctgcgctgctttgcccgggagagctgcggccttgtttactttaagctgcccgaggagcaccctaacggccctgcacacggagtgcggatcaccgtagagggcaccaccaagtcttacctggtcaggttttttacccagcaacccttcctggtcgagcgggaccggggcgccaccacctacaccgtgtactgcatttgtccaaccccgaagttgcatgagaatttttgctgtactctttgtggtgagtttaataaaagctgaaataagactctactctggaatccagtgtcgtcataatcgcaccaagaccattaactttaccacccaggaacaggtgaactttacctgcaaaccccacaagaagtacctcatctggttcctcaagaacactacttttgcagtagttaacacctgtgacaacgacggtgttcttcttcccaacaatcttaccagtggactagccttctctgttaaaagggcaaagctaattcttcatcgccctattgtagaaggaacttaccattgtcagagcggaccttgtcatcacattttccatttggtgaacgtcaccagcagcagcaacagctcagaaactaacctctcttctcgtactaacagacctcaattcggaggtgagctaaggcttcccccttgtaaggagggggttagcccatacaaggtggtcgggtatttaattttaggggcggtcctgggtgggtgcatagcggtgctagcccaactgccttgctgggtggaaatcaatctttatctgctgggttagatattgcggggaggaaccatgaaggggcttttgctaattatcctttccctggtggggggtgtactgtcatgccacgaacagccacgatgtaacattaccacaggcaatgagaggagtgttatatgtacagtagttattaaatgcgagcatcaatgccctctcaacattacatttaaaaaccgtaccatggggaatgcatgggtaggctactgggaaccaggagatgagcagaactacacggtcactgtccatggtagcgatggaaatcacactttcggtttcaaatttatttttgaagtcatgtgtgatatcacactgcatgtggctagacttcatggcttgtggccccctaccaaggagaacatggttgggttttctttggcttttgtaattatggcctgctttatgtcaggtctgctggtaggggctctaatgtggtttttaaagtgcaagcccaggtatggaaatgagcagaaggaaaaattgctataaattttttttttttttttacagtaccatgaatactttaaccagtgtcgtgctgctctctcttcttgtagcttttagtgaggcaggaattattaacttaaatgtatcatggggaatcaatctaactttagtgggaccattagacctgccagttacatggtatgatggaaagggaatgcagttttgtgatggaaatacaattaaaaacccacaaatcaagcatagctgtaatcaacaaaatctaactttacttaatgctgacaagtctcatgaaaggacttacttaggttacagacatgacagtaagggaaaagtagactataaggttacagtcataccacctccttcaaccactcgcaagcctttgtcacagcctcactatgttactgtgactatgaaccataacatgactttagtgggtcccttaaacctgccagttacatggtatgatggagaaggaaataaattgtgcaatggagaaaaagttgagcatgcagaatttaatcatacatgtaacatccagaacctgacactgctctttgttaacttaacgcataatggagcatacattggttataacaaagacggttctaatagagaattatatgaggtgtcagtcaaaaccttgtttcaaaacggggctaaacaaagtaaggttgaacaaagtaatattggacaaggtaatactgctcaaagtgcaaaaagaaaatcaacaaataaccttcagccaacacaattgtatgttagaccttttactaatgttagtttaactggacctccaaatggcaaggttatttggtatgatggcgaacttaatgatccatgtgaacaaaagtacaaacttaaaactttttgcaatcagcaaaatctaactttaattaatgtaaccagcacttatgatggcatctattatggtactgatgaaaaagataaggcaaatcgttacagaataaaagtaaatactacaaatcacaaaactgttaaaattaagccacataccaaagaacctcctgctgaacaaaaaaaacagtttcaattacaagttgcagaaactgatcaaaacgaatcaaaaattccctcagctactgtggcaatcgtggtgggagtgattgcgggctttgtaactctaatcattgtttttatttgctacatctgctgccgcaagcgtccaagggcatacaattatatggtagacccactactcagcttctcctactaaaactcagtcattcttatttcagaaccatgaaggctttcacagcttgcgttctgattagcatagtcacacttagtctttctcaaatcattaatgtaaatgttaccagaggaggtagtattacattaaatggaacttataaaaacactacatggacaagatatcacttagactcatggaaaaatttatgcaagtggaatatgacagcttacaagtgttatgataatggaagcattactattactgccactggtaaaattacttctggcaaatacaaggcagaaagttacaaaaatgaaattaagaaatcagtatttaaaactaataaaactacatttgaagattctggaaattatgaacatcaaaaaataactttctatcagctaacaattattcaactacctactactaaggtaccaaccaccacagccagtacatacactacacagctaaacacaacagtgcagaatagtactgtgttggttaggtacttgctgagggaggaaagtactactcaacagacagatgctaccttaagtgcctttagcagcactgcaaatttaacttcgcttgcttggactaatgaaaccggagtattattaatgcatggccagccttactcaggtttgcatattcaaattacttttctggttatctgtgggatctttattctcgtggttcttttgtactttgtttgctgcaaagccagaaaaaaatctaggagacccatctacaggccagtaatcgggaatcctcagcctttccaagtggaagggggtctaaggaatcttcttttttctttttcagtatggtgatcagccatgattcctaggttcttcctatttaacatcctcttctgtctttttaacgtgtgcgctgcctttgcggccgtttcgcacacctcacccgactgtcttgggccattccccacctaccttctctttgccctgctcacctgcacctgcgtctgcagcattgtctgcctggtcattaccttcctgcagcttatcgactggtgctgcgcgcgctacaattatcttcaccacagtcccgaatacagggacaagaacgtagccaaactcttaaggcttatatgaccatgcagactctgctaatactgctatcccttttatcccccgcccttgccacttttgattactctaaatgcaaatttgttgagctatggaatttcttaaactgctataatgctacaatggatatgccttcctattacttggtaattgtgggaatagtgatggtctgctcctgcactttctttgctattatgatctacccctgttttgatctcggctggaactctgttggggcatttacatacacactacaaaacagttcaccagccttcacaccgcctccccgcagaaatcagttccccctgattcagtacttagaagagccccctccccggcccccttccactgttagttactttcacataaccgccggcgatgactgacaaccacctggaccttgagatggacggccaggcctccgagcaacgcatcctgcaactgcgcgtccgtcagcagcaggagcgaaccgccaaggagctccttgatgccatcaacatccaccagtgcaagaaaggcattttttgcctggtcaaacaggcaaaaattacctacgagcttatgtccggcggcaagcagcatcgccttgcctatgagctgccccagcagaagcaaaagttcacctgcatggtgggcgtcaaccccatagtcatcacccagcagacgggcgaaaccagcggctgtatccattgctcctgcgaaagccccgagtgtatctactccctccttaagaccctttgcggacttcgcgacctcctacccataaactaattgattaaagtttagaaaccaatcacaccccattccccattttcccacataaacaatcattagaaataattacttaataaaaattacttacttgaaatctaaaagtatgtctctggtgtagttgtttagcaatacctcggtcccctcctcccagctctggtactccagtccccggcgggcggcgaacttcctccacaccttgaaagggatgtcaaattcctggtccacaattttcattgtcttccctctcagatgtcaaagaggctccgggtggaagatgacttcaatcccgtctacccctatggctacgcgcggaatcaaaatatccccttccttactcccccctttgtctcctccaatggattccaaaacttcccccctggggttctgtcactcaaactggctaacccaatcaccatcaccaatggaaatgtctcactcaaggttggaggtgggctaactttgcaagaagaaactggaaaactaacagttaatactgaaccacctttgcaacttacaaataacaaattaggtattgctttagacgctccatttgatgttatagacaataagctgacactattagcaggccatggcttgtctattataacaaaagaaacatcaacactgcctggcttggttaatactcttgtagtattaactggaaagggtattggaacagattcacataatggtggaaatatatgtgttagagttgcagaaggcggtggcttatcatttaatgataatggagacttggtagcatttaataaaaaagaagataaacgcaccctatggacaactccagacacatctccaaattgcagaattgatcaggataaggactctaagctaactttggtccttacaaagtgtggaagtcaaatattagccaatgtgtcattaattgtcgtagctggaaggtacaaaattatcaataacaatactcaaccagctctcaaaggatttaccattaaattgttgtttgataaaaatggagtccttatggaatcttcaaatcttagtaaatcatattggaactttcgaaatgaaaattcaattatgtcaacagcttatgaaaaagctattggttttatgcctaatttggtagcctatccaaaacctaccactggctctaaaaaatatgcaagagatatagtttatggaaacatctaccttggcggaaagccacatcaaccagcaaccattaaaactacctttaaccaggaaactggatgtgaatactctattacatttgattttagttgggccaaaacttatgtaaatgttgaatttgaaactacctcttttaccttttcctatattgcccaagaataaaagacaaataaacgtgtttttcatttaaaaatttcatgtatctttattaatttttacaccagcgcgggtacacattctcccaccaccagcccattttacagtgtaaacaattctctcagtacgggtggccttaaataggggaaagttctcattagtgcgggaactggacttggggtctataatccacacagtttcctggcgagccaaacgggggtcggtgattgagatgaagccgtcctttgacaaatcatccaagcgggcctcacagtccaaggtcacagtctggtggaatgagaagaacgcacagactcatactcggaaaacaggatgggtctgtgcctctccatcagcgcccttaacagtctttgccgccggggctcggtgcggctgctacaaatgggatcgggatcgcaagtctctttgactataatccccacagccctcagcatcagtcttctggtgcgtcgggcacagcaccgcattctaatttcgctcatgttttcacagtaagtgcagcacataatcattatgttattcagcagcccataatttagggtgctccagccaaagcttatgttgggaatgatggaacccacgtgaccatcgtaccaaatgcggcagtatatcaggtgcctgccccttataaacacactgcccatatacataatctctttgggcatatttctgttcacaatctgccggtaccaggggaagcgctggttaaacatgcacccgtaaatgactctcctaaaccacacggccagcagggtgcctcccgcccggcactgcagggagcccggggatgaacagtggcaatgcaggatccagcgctcgtacccgcttaccatctgggctctcaccagatccagggtagcgggacacaggcacactgacatacatctttttaaaatttttacttcctttgtggtcaggatcatatcccaggggactggaaactcttgcagcag

SEQ ID NO: 1451 - DNA, 32767 bp, Human mastadenovirus D
ctatctatataatataccccacaaagtaaacaaaagttaatatgcaaatgagcttttgaattttaacggttgtggggcggagccaacgctaattggacgagaagcggtgatgcaaataacgtcacgacgcacggctaacggccggcgcggaggcgtggcctaggccggaagcaagtcgcggggctgatgacgtataaaaaagcggactttagacccggaaacggccgattttcccgcggccacgcccggatatgaggtaattctgggcggatgcaagtaaaattaggtcattttggcgccaaaactgaatgaggaagtgaaaagtgaaaaatacctgtcccgcccagggcggaatatttaccgagggccgagagactttgaccgattacgtggggtttcgattgcggtgtttttttcgcgaatttccgcgtccgtgtgaaagtccggtgtttatgtcacagatcagctgatccacagggtatttaaaccagttgagcccgtcaagaggccactcttgagtgccagcgagtagagatttctctgagctccgctcccagagtctaaaaaaaatgagacacctgcgccttctgtcttcaactgtgcctattaacatggccgcattattgctggaggactatgtgagtacagtattggaggacgaactacatccatctccatttgagctgggacctacacttcaggacctttatgatttggaggtagatgcccatgatgacgacccaaacgaagaggctgtgaatttaatatttccagaatctctgattcttcaggctaacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatggctctaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtgaatgtgagagaggcgagtgcttaacacataactgggtgatgcttaaacagctgtgctaagtgtggtttatttttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactaggctcagctgtgcttagtcatgtgtaaataaagttgtacaataaaagtatatgtgacgcatgcaaggtgtggttcatgattcatgggcggggcttagtcctatataagtggcaacacctgggcactggggcacagacctttagggagttcctgatggatgtgtggactatccttgcagactttagcaagacacgccgacttgtagaggatagttcagacgggtgctccgggttctggagacactggtttggaactcctctatctcgtctggtgtacacagttaagaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggactttgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggccaggggagtgaagagggagaggagcgatgggggcaataccgggatgatgaccgagctgacggccagcctgatgaatcgcaagcgcccagagcgcattacctggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggctttaacaatatgtgcgccgaggtctggggcgcttccaagatcaggggatgtaagttttatggctgctggatgggcgtggtcggaagacccaagagcgagatgtctgtaaagcagtgtgtgtttgagaaatgctacctgggagtctctaccgagggcaatgctagagtgagacactgctcttccctggatacgggctgcttctgcctggtgaagggtacggcctctctaaagcataatatggtgaagggctgcacagatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaatgtgagtataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagccctgagccgtcagctggccgccctgacccagcaggtgtccgagctccgcgaacagcagcagcagcaaaataaatgattcaataaacacagattctaattcaaacagcaaagtatctttattatttattttttcgcgcgcgataggccctggtccacctctcccgatcattgagagtgcggtggattttttccaggacccggtagaggtgggattggatgttaaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactaatggccacggggagccccttggtgtaggtgttggcgaagcggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcataattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgattagctgcgaggagagcaggtttctcaacagctgggacttgccgcacccggtcgggccgtagatgaccccgatgactggttgcaggtggtagttcaaggagatgcagctgccgtcgtcccggagaaggggggccacctcgttgagcatgtccctgacttggaggttttcccggacgagctcgccaaggaggcggtccccgcccagcgagagcagctcttgcagggaagcaaagtttttcagtggcttgagcccgtcggccatgggcatcttggcgagggtctgcgagaggagctcgaggcggtcccaaagctcggtgacgtgctctacggcatctcgatccagcagacttcctcgtttcgggggttgggacgactgcgactgtagggcacgagacgatgggcgtccagcgctgccaacgtcatgtccttccagggtctcagggtccgcgtgagcgtggtctccgtcacggtgaaggggtgggccccgggctgggcgcttgcaagggtgcgcttgagactcatcctgctggtgctgaaacgggcacggtcttcgccctgcgcgtcggcgagatagcagttgaccataagctcgtagttaagggcctcggcggcgtggcccttggcgcggagcttgcccttggaagagtgaccgcaggcgggacagaggatggattgcagggcgtagagcttgggtgcaagaaagacggactcgggggcgaaggcgtccgctccgcagtgggcgcagacggtctcgcactcgacgagccaggtgagctcggggtgttcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccaccgtgtgcagacacatgtccccctcctccgcattcaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcaatgctttttaggagactttcatccatctggtcagaaaaaactatttttttattgtcaagcttggtggcaaaggagccatagagggcgttggagagaagcttggcgatggatctcatggtctgatttttgtcacggtcggcgcgctccttggccgcgatgttgagctggacatattcgcgcgcgacacacttccattcgggaaagacggtggtgcgctcgtcgggcacgatcctgacgcgccagccgcggttatgcagggtgaccaggtcaacgctggtggccacctcgccgcgcaggggctcgttggtccagcagagtctgccgcccttgcgcgagcagaaagggggcagtacatcaagtagatgctcgtcaggggggtccgcatcgatggtgaagataccgggacagagttccttgtcaaaatagtctatttttgaggatgcatcatccaaggccatctgccactcgcgggcggccatcgctcgctcgtaggggttgaggggcggaccccagggcatgggatgcgtgagggcggaggcgtacatgccgcagatgtcatagacatagatgggctccgagaggatgccgatgtaggtgggataacagcgccccccgcggatgctggcgcgcacatagtcatacaactcgtgcgagggggccaagaaggcggggccgagattggtgcgctggggctgctcggcgcggaagacgatctggcgaaagatggcatgcgagttggaggagatggtgggccgttggaagatgttaaagtgggcgtgcggcagtcggaccgagtcgcggataaagtgcgcgtaggagtcttgcagcttggcgacgagctcggcggtgacaaggacgtccatggcgcagtagtccagcgtttcgcggatgatgtcataacccgcctctcctttcttctcccacagctcgcggttgagagcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccggaacggaggctcggttgttgatgacctgggcggcgaggacgatctcgtcgaagccgttgatgttgtgcccgacgatgtagagttccatgaatcgcgggcggcctttgatgtgcggcagctttttgagctcatcgtaggtgaggtcctcggggcattgcaggccgtgctgttcgagcgcccactcctggagatgtgggttggcttgcatgaatgaagcccagagctcgcgggccatgagggtctggagctcgtcgcgaaagaggcggaactgctggcccacggccatcttttcgggtgtgacgcagtagaaggtgagggggtcccgctcccagcgatcccagcgtaagcgcgcggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaattggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggaatggcggccctggctggtggttttcatgttcgcctgcgtgggactcaccctggggctcctcgaggacggagaggctgacgagcccgcgcggcagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcggacgcgctcccggcggcagcggcacgttggcgtggcgctcgggcaggtcccggtgctgcgccctgagagcgctggcgtgcgcgacgacgcggcggttgacatcctggatctgccgcctttgcgtgaagaccactggccccgtgactttgaacctgaaagacagttcaacagaatcaatctcggcgtcattgacggcggcctgacgcaggatttcttgcacgtcgcccgagttgtcctggtaggcgatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcatagttgcgcaggcgttggaagaggtagttgagggtggtggcgatgtgctcggtgacgaagaagtacataatccagcggcgcaggggcatttcgctgatgtcgccaatggcctccagcctttccatggcctcgtagaaatccacggcgaagttgaaaaactgggcgttgcgggccgagaccgtgagctcgtcttccaggagcctgatgagttcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggtgggtccccgttgggcagcgatagggcgctgacaatgcatcttatcaattgcggtgtagggcacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgaacggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccataagcgaccagttgacggtctgcaggccgggttgcacgacctcggagtacctgagccgcgagaaggcgcgcgagtcgaagacatagtcgttgcaggtgcgcacgaggtactggtatccgactagaaagtgcggcggcggctggcggtagagcggccagcgctgggtggccggcgcgcccggggccaggtcctcaagcatgagtcggtggtagccgtagaggtagcgggacatccaggtgatgccggcggcggtggtggaggcgcgcgggaactcgcggacgcggttccagatgttgcgcaggggcaggaaatagtccatggtcggcacggtctggccggtgagacgcgcgcagtcattgatgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgtcggccgaggggagtcgctagacttgaaagcggccgaaaaccctgccgggtagtggctcgcgcccgtagtctggagaagcatcgccagggttgagtcgcggcagaacccggttcaaggacggccgcggcgagcgggacttggtcaccccgccgatttaaagacccaacagccgacttctccagttacaggaaagagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcacagctgttcctggtggtgcagcacagcagggacaacgaggcgttcagggaggcactgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtatgtgcccatagacaaggaggtgaagatagacagcttttacatgcgcatggcgctcaaggtgctgacgctgagcgacgacctgggcgtgtaccgcaacgaccgcatccacaaggccgtgagcacaagccggcggcgcgagctgagcgaccgcgagctgatgctgagtctgcgccgggcgctggtaggaggcgccaccggcggtgaggagtcctactttgacatgggggcggacctgcattggcagccgagccgacgcgccttggaggccgcctacggtccagaggacttggatgaggaagaggaagaggaggaggatgcacccgttgcggggtactgacgcctccgtgatgtgtttttagatgcagcaagccccggaccccgccataagggcggcgctgcaaagtcagccgtccggtctagcatcggacgactgggaggccgcgatgcaacgcatcatggccctgacgacccgcaaccccgagtcctttagacaacagccgcaggccaacagactctcggccattctggaggcggtggttccttctcggaccaaccccacgcacgagaaggtgctggcgatcgtgaacgcgctggcggagaacaaggccatccgtcccgacgaggccgggctagtgtacaacgccctgctggagcgcgtgggccgctacaacagcacaaacgtgcagtccaacttggaccggctggtgacggacgtgcgcgaggccgtggcgcagcgcgagcggttcaagaacgagggcctgggttcgctggtggcgctgaacgccttcctggcgacgcagccggcgaacgtgccgcgcgggcaggatgattataccaactttataagcgcgctgcggctgatggtgaccgaggtgccccagagcgaggtgtaccagtcgggcccggactactttttccagacgagcagacagggcctgcagacggtgaacctgagtcaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtgaaccgcaactcgtacctgggtcacctgctgacgctgtaccgcgaggccataggccaggcgcaggtggatgagcagaccttccaggagatcactagcgtaagccgcgcgctgggtcagaacgacaccgacagtctgagggccaccctgaacttcttgctgaccaatagacagcagaagatcccggcgcagtacgcgctgtcggccgaggaggagcgcatcctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggtcaataacgggatagagagtctggtggacaaactgaaccgctggaaaacctacgctcaggaccatagggaacctgcgcccgcgccgcggcgacagcgtcacgaccggcagcggggcctggtgtgggacgacgaggactcggccgacgatagcagcgtgttggacttgggcggaagcggtggggccaacccgttcgcgcatctgcaacccagactggggcgacggatgttttgaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccctgccgaggccagcacgcagacgataaattttgacgagcggtcgcggtggggcggtgatctgaagaccattctgcacaccaacatgcctaatgtgaacgagtacatgttcaccagcaagtttaaggcgcgggtgatggtggctagaaaaaaggcggaaggggctgatgcaaatgataggagcaaggatatcttagagtatcagtggtttgagtttaccctgcccgagggcaacttttccgagaccatgaccatagacctaatgaacaacgccatcttggaaaactacttgcaagtggggcggcaaaatggcgtgctggagagtgatatcggagtcaagtttgacagcagaaatttcaagctgggctgggacccggtgaccaagctggtgatgccaggggtctacacctacgaggccttccacccggacgtggtgctgctgccgggctgcggggtggatttcaccgagagccgcctgagcaacctcctgggcattcgcaagaagcaaccttttcaagagggcttcagaatcatgtatgaggacctagtagggggcaacatccccgctctcctgaatgtcaaggagtatctgaaggataaggaagaagctggcaaagcagatgcaaatactattaaggctcagaatgatgccgtcccaagaggagataactatgcatcagcggcagaagccaaagcagcaggaaaagaaattgagttgaaggccattttgaaagatgattcagacagaagctacaatgtgatcgagggaaccacagacaccctgtaccgcagttggtacctgtcctatacctacggggatcccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctttgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaaacgctcccagcagcaccccgtccgcgtccgcggtcacttccgcgctccctggggcgcttacaagcgggggcggacctctgctcctgccgccgtgcgcaccaccgtcgacgacgtcatcgactcggtggtcgccgatgcgcgcaactacacccccgccccctcgaccgtggacgcggtcatcgacagcgtggtggcagacgcgcgtgactatgccagacgcaagagccggcggcgacggatcgccaggcgccaccggagcacgcccgcaggcaggactcgcagacgagcggccgctgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctatgggaagcggtcgcgcgaagaggagctcatctcgctgccgctggacgaaagcaatcccacgccgagcctgaagcccgtgaccctgcagcaggtgctgccgagccgcgggatcaagcgcgagggcgagaacatgtacccgaccatgcagatcatggtgcccaagcgccggcgcgtggaggacgtgctggacaccgtgaaaatggatgtggagcccgaggtcaaggtgcgccccatcaagcaggtggcgccgggccttggcgtgcagaccgtggacattcagatccccaccgacatggatgtcgacaaaaaaccctcgaccagcatcgaggtgcagaccgacccctggctcccagcttccaccgctaccgcctccacttctaccgccgccacggctaccgagcctcccaggaggcgaagatggggccctgccaaccggctgatgcccaactacgtgttgcatccttccatcatcccgacgccgggctaccgcggcacccggtattacgccagccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagggaaaagctcaaagaccagaacttccagcaaaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcgaccgcggcccgacgcggaggagacaatcctgcaagtggacgagccgccctcgtacgaggaggccgtcaaggccggcatgcccaccacgcgcatcatcgcgccgctggccacgggtgtaatgaaacccgctacccttgacctgcctccaccacccacgcccgctccaccaaaagcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagcctggcccccaagggcgcccctaactccagtcagtgggcgcagaaaaagactggtgaagacaatcaaactgaaacacgcacatttggtgtggccgctatgggtggaatacttattgataaaaatggtcttcagattggaacagatgaaactaaacccgataacaaggaaatttatgcagacaaaacattccagccagaacctcaaaaaggtgaagaaaactggcaagatggagatgttttctatggaggcaggactattaaaaaggaaaccaaaatgaagccatgctatggctcatttgccagacccactaatgaaaagggaggtcaggcaaaatttaaaactaatgccgaaggtcagcccacagaggagttagacattgacctgaacttctttgatattaatggaggggcaggtgataatgaatttaacccagacatggtcatgtatgctgagaatatgaatctggagacgccagatacacatgtggtgtacaaacctggaacttcagatgacagttctgaagctaacttagcgcagcagtccatgcccaacagaccaaactacattggcttcagagacaattttgtggggctcatgtactacaacagcactggcaacatgggtgtgctggctggtcaggcatctcagttgaatgctgtggtcgacttgcaagacagaaatactgagctgtcttaccagctcttgctagattctctgggtgacagaacaagatactttagcatgtggaactctgcggtggacagctatgatcccgatgtcaggatcattgagaatcacggtgtggaagatgaacttccaaactattgcttcccattggatggcactggcaccaattctacataccaaggggttaaagaaacagctgctcagaatggatgggaaaaagatccaaatgttgctgctcagaaccaaatttgcaagggcaacatctatgccatggagattaacctccaggccaacctgtggaagagttttctgtactcgaacgtggccctgtacctgcccgactcctacaagtacacgccggccaacgtcacgctgcccgccaacaccaacacctacgagtacatgaacggccgcgtggtagccccctcgctggtggacgcctacatcaacataggcgcccgctggtcgctggaccccatggacaatgtcaaccccttcaaccaccaccgtaacgcgggcctgcgctaccgctccatgcttttgggcaatggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatttccatcccctcgcgcaactgggccgccttccgcggctggagtttcacccggctcaagaccaaggaaactccctcccttggctcgggttttgacccctactttgtctactcgggctccatcccctacctcgacgggaccttctacctcaaccacaccttcaagaaggtttccatcatgttcgactcctcggtcagctggcccggcaacgaccggctgcttacgccgaacgagttcgagatcaagcgcagcgtcgacggggagggctacaacgtggcccaatgcaacatgaccaaggactggttcctcgtccagatgctctcccactacaacatcggctaccagggcttccatgtgcccgagggctacaaggaccgcatgtactccttcttccgcaacttccagcccatgagcaggcaggtggtcgatgagatcaactacaaggactacaaggcagtcaccctgcccttccagcacaacaactctggctttaccggctacctggcacccaccatgcgtcaggggcagccctaccccgccaacttcccctacccgctcatcggctccaccgcagtgccatccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtacgcgacctgggctgcgggccctactttttgggcacccacgacaagcgcttcccgggcttcctcgccggcgacaagctggcctgcgccatcgtcaacacggccggccgcgagaccgggggcgtgcactggctcgcctttggctggaacccgcgctcgcgcacctgctacatgttcgaccccttcgggttctcggaccgccggctcaagcagatttacagcttcgagtacgaggccatgctgcgccgaagcgccctggcctcctcgcccgatcgctgtcttagcctcgaacagtccacccagaccgtgcaggggcccgactccgccgcctgcggactcttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctaccgcttcctcgcgcgccactccccctactttcgctcccaccgcgccgccatcgaacacgccaccgcttttgataaaatgaaacaactgcgtgtatgactcaaataaacagcacttttattttacacatgcgctggagtatatgcaagttatttaaaagtcgaaggggttctcgcgctcgtcgttgtgcgccgcgctggggagggccacgttgcggtactggaacttgggctgccacttgaactcggggatcaccagtttgggcactggagtctcggggaaggtctcgctccacatgcgccggctcatttgcagggcgcccagcatgtcagggccggagatcttgaaatcgcagttgggaccggtgctctgcgcgcgcgagttgcggtacacggggttgcagcactggaacaccatcagactggggtacttcacactggcaagcacgctcttgtcgctaatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctaaaaaacaggccgcagctcttcccgctgaactggttattcccgcacccggcatcatgcacgcagcagcgcgcgtcatggctggtcagttgcaccacgctccgtccccagcggttctgggttaccttagccttgctgggctgctccttcagcgcgcgctgtccgttctcgctggtcacatccatctccaccacgtggtccttgtgaatcatcaccgttccatgcagacacttgagctgaccttccacctcggtgcagccgtgatcccacaggacgcagccggtgcactcccaattcttgtgcgcgatcccgctgtggctgaaaatgtaaccttgcaacaggcgacccataatggtgctaaatgctttctgggtggtgaatgtcagttgcatcccgcgggcctcctcgttcatccaggtctggcacatcttctggaagatctcggtctgctccggcatgagcttgtaagcatcgcgcaagccgctgtcgacgcggtagcgttccatcagcacgttcatggtatccatgcccttctcccatgacgagaccagaggcagactcagggggttgcgcacgttcaggacaccaggggtcgcgggctcgacgatgcgttttccgtccttgccttccttcaacagaaccggaggctggctgaatcccactcccacgatcacggcgtcttcctggggcatctcttcgtcggggtctaccttggttacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctaaaacccccacaggatgaacaggagcacgagcaagacgcaggccaggaggagaccgacgctgggctcgagcatggctacctgggaggagaggaggatgtgctgctaaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccatctcctgtcgcgccaatcgcactcgcgccaacgcgctcctcgctctggggcccggcgcgcgcatacctgatatcgcttccctggaagaggtgcccaagatcttcgaagggctcggtcgggacgagacgcgcgcggcaaacgctctgaaaaaaacagcagaggaagagggttacactagcgccctggtagagttggaaggcgacaacgccaggctggccgtgcttaagcgcagcgtcgagctcacccatttcgcctaccccgccgtcaacctcccgcccaaggtcatgcgtcgcatcatggatcagctcatcatgccccacatcgaggcccttgatgaaagtcaggaacagcgccccgagaacgcccagcccgtggtcagcgacgagatgctcgcgcgctggctcgggacccgcgacccccaggccctggagcagcggcgcaagctcatgctggccgtggtcctggtcacccttgagctcgaatgcatgcgccgcttttttaccgaccccgagaccctgcgcaaggtcgaggagaccctgcactacactttcagacacggtttcgtcaggcaggcctgcaagatctccaacgtggagctgaccaacctggtctcctgcctggggatcctacacgagaaccgcttgggacagaccgtgctccactctaccctgaagggcgaggcgcggcgggactacatccgcgactgcgtctttctctttctctgccacacatggcaagcggccatgggcgtgtggcagcagtgtctcgaggacgagaacctgaaggagctggacaagcttcttgctagaaaccttaaaaagctgtggacgggctttgacgagcgcaccgtcgcctcggacctggccgagatcgtcttccccgagcgcctgaggcagacgctgaaaggagggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacattgcccaccactcggatgtgatcgaggacgtgagcggcgaggggctgctcgagtgccactgtcgctgcaacctatgctccccgcaccgctccctggtctgcaacccccagctactgagcgagacccaggtcatcggtacctttgagctgcaaggtccgcaggagtccaccgctccgctgaaactcacgccggggttgtggacttccgcgtacctgcgcaaatttgtacccgaggactactacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagacttggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcgacagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctaaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgggaattacctcatcgccaccatgagcaaggagattcccaccccttacatgtggagctatcagccccagatgggcctggccgcaggcgcctcccaggactactccacccgcatgaactggctcagtgccggcccctcgatgatctcacaggtcaacggggtccgtaaccatcgaaaccagatattgttggagcaggcggcggtcacctccacgcccagggcaaagctcaacccgcgtaattggccctccaccctggtgtatcaggaaatccccgggccaactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgatgcagtgagagaagcggtggacggctacgactgaatgtcccatggtgactcggctgagcttgctcggttgaggcatctggaccactgccgccgcctgcgctgcttcgcccgggagagctgcggactcatctactttgaatttcccaaggagcaccccaacggcccggcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgttgtactctgtgtgctgagtttaataaaagctaaactcctacaatactctggaatcccgtgtcgtcgcactcgcaacgagatcttcaacctcaccaaccagactgaggtaaaacttaactgcagaccggggggcaaatacatcctctggctctttgaaaacacttccttcgcagtctccaacgcctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagccgctccagaaacatctaacctttttgatactaacactcctaaaaccggaggtgagctctgggttccctctttaacagaggggggtaaacatattgaagcggttgggtatttgattttaggggtggtcctgggtgggtgcatagcggtgctgtattaccttccttgctggaacgaaatcaaaatctttatctgctgggtcatacattgttgggaggaaccatgaaggggctcttgctgattatccttttcctggttgggggtgtactgtcatgccacgaacagccacgatgtaacatcaccacaggcaatgagaggagtgtgatatgcacagtagtcatcaaatgcgagcatacatgtcctctcaacatcacattcaagaataagaccatgggaaattcatgggtgggcgattgggaaccaggagatgagcagaactacacggtcactgtccatggtagcgatgggaatcacactttcggtttcaaattcatttttgaagtcatgtgtgatatcacactgcatgtggctagacttcatggcttgtggccccctaccaaggagaacatagttgggttttctttggcttttgtgatcatggcctgctttatgtcaggtctgctggtaggggctttagtatggttcctgaagcgcaagcctaggtatggaaatgaggagaaggaaaaattgctataaatctttttctcttcgcagaaccatgaatactttgaccggtgtcgtgctgctctctcttcttgtagcttttagtcaggcaggatttcatactatcaatgctacatggtgggctaatataactttagtgggaccctcagatacgccagtcacatggtatgataaacagggaatgcagttctgtgatggaaatacagttaagaatcctcaaataagacatgagtgtaatgagcaaaaccttacactaattcatgtgaacaaaacccatgaaaggacatacatgggttataatagacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgacgagcaaaatcttacactgttgtttataaatcttacacatgatggggcttatcttggctataatcgccagggaactaaaagaacttggtatgaggttgtagtgacagatggttttccaaaatcaggggagatgaaaatcgaagatcagagtagacaaaatgagcataaacagggtgggcagaaacaggaggggcaaaaagagacaagtcaaaagaaagctaatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgcgagcctgggtataagttagggtgtaagtgtgacaatcaaaacctaacgctaatcaatgtaactaaactttatgagggagtttactatggtactaatgacagaggcaacagcaaaagatatagagtaaaagtaaacactactaattctcaaagtgtgaaaattcagccatacaacaggtctactactcctaatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactacttagcttctcttactgagactcagtcactttcatttcagaaccatgaaggctttcacagcttgcgttctgattagcatagtcacattagtatcagctgattacaaacaagttcaagttagcagaggaggaaacattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaggttagaacattttcatctagaaatcaaaaacatacaattgaagattctggagattatgaacaacaaaaaatatatctatataatctaacaataattgaaccgccaactactaaagcacccaccatagttagaacaactactagggaaacaacacatccaaccaccacaactcacactacacatctagacactacagtgcagaatactactttattgattgggtttttaataagaggaaatgaaagtactactgatcagacagaggctacctcaagtgccttcagcagcactgcaaatttaacttcgcttgcttcggtaaatgaaacgatcgtgccaatgatgtatggccaaccttactcaggtttggatattcaaattacttttctggttgtctgtgggatctttattcttgtggttcttctgtactttgtctgctgcaaagccagagaaaaatctaggaggcccatctacaggccagtaattggggatcctcagcctctccaagtggaagggggtctaaggaatcttctcttctctttttcagtatggtgattcagccatgattcctaggttcttcctatttaacatcctcttctgtctattcaacgtgtgcgctgccttcgcggccgtctcgcacgcctcgcccgactgtcttgggcccttccccacctaccttctttttgccctgctcacctgcacctgcgtctgcagcattgtctgcctggtcgttaccttcctgcagctcatcgactggtgctgcgcgcgctacaattatctccaccacagtcccgaatacagggacgagaacgtagccagaatcttaaggctcatttgaccatgcagactctgctcatactgctatccctcctctcccctgccctcgctgatgatgattactctaagtgcaaatttgtggagctatggaatttcttagactgctatgatgttaaaatggatatgccatcctattacttggtgattgtggggatagtcatggtctgctcctgcactttctttgccatcatgatctacccctgttttaatctcggctggaactctgttgaggcattcacatacacactagaaagcagttcactagcttccacgccgccacccacaccgcctccccgcagaaatcagtttcccatgattcagtacttagaagagccccctccccggcccccttccactgttagctactttcacataaccggcggcgatgactgacaaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctccttaaaaccctttgcggactccgcaaccttcttcccacaaactaactgatttaagcccaaaaaccaatcaaacccccttttcccatctacccaaataaacatttattggaaataattattcaataaagatcacttacttaaaatctgaaagtatgtctttggtgtagttgtttagcagcacctcagtcccctcctcccagctctggtactccagtccccggcgggcggcaaactttctccacaccttgaaagggatgtcaaattcctggtccacaattttcattgtcttccctcttagatgacaaagagactccgggtggaagatgacttcaaccccgtctacccctatggctacgcgcggaatcaaaatattcccttcctcactcccccctttgtctcctccaatggatttcaaaacttcccccctggggtcctgtcacttaaactggctgacccaatcaccattaacaatcaaaatgtatcactcaaggttggaggggggctaactttgcaagaagaaactggaaaattaacagttaatactgaaccacctttgcatcttacaaataacaaattagggatagctttagacgctccatttgatgttatagacaataagcttacactattagcaggccatggcttgtctattataacaaaagaaacatcaacactgcctggcttggttaatactcttgtagtattaactggaaagggtattggaacagatttatcaaataatggtggaaatatatgtgttagagttggagaaggcggcggcttatcatttaatgacaatggagacttggtagcatttaataaaaaagaagacaaacgcaccctatggacaactccagacacatctccaaattgcagaattgatcaggataaggactctaagctaactttggtccttacaaagtgtggaagtcaaatattagccaatgtgtcattaattgttgtagctggaaggtacaaaattatcaataacaatactaatccagctcttaaaggatttaccattaaattgttgtttgataaaaatggagtccttatggaatcttcaaatcttggtaaatcatattggaactttcgaaatcaaaattcaattatgtcaacagcttatgaaaaagctattggttttatgcctaatttggtagcctatccaaaacctaccactggctctaaaaaatatgcaagagatatagtttatggaaacatctaccttggcggaaagccacatcaaccagtaaccattaaaactacctttaaccaggaaactggatgtgaatactctattacatttgattttagttgggccaaaacttatgtaaatgttgaatttgaaactacctcttttaccttttcctatattgcccaagaataaaggataaataaacgtgtttttcatttaaaaatttcatgtatctttattgatttttacaccagcgcgggtacacattctcccaccaccagcccattttacagtgtaaacaattctctcagcacgggtggccttaaataggggaaagttctcattagtgcgggaactggacttggggtttataatccacacagtttcctggcgagccaaacgggggtcggtgattgagatgaagccgtcctttgaaaaatcatccaagtgggcctcgcagtccaaggtcacagtctggtggaatgagaagaacgcacagactcatactcggaaaacaaaatgggtctgtgcctctccatcagcgcccttaacagtctctgccgccggggctcggtgcggctgctacagatgggatcgggatcgcaagtctctctcactataatccccacagcctttagcattagtcttctggtgcgtcgggcacagcaccgcatcctaatctcgctcatgttttcacagtaagtgcagcacataatgaccatgttattcagcagcccataatttagggtgctccagccaaagcttatgttggaaatgatggaacccacgtgaccatcgtaccaaatgcggcagtatatcaggtgcctgccccttataaacacactgcccatatacataatctctttggacatgtttctatttacaatctgccggtaccaggggaagcgctggttaaacatgcacccgtaaatgactctcctaaaccacacggccagcagggtgcctcccgcccggcactgcagggagcccggggataaacagtggcaatgcaggatccagcgctcgtacccgcttaccatctgggctcttaccagatccagggtagcgggacacaggcacactgacatacatctttttaaaatttttatttcctttcgggtcaggatcatatcccaggggactggaaactcttggagcagggtaaaa

SEQ ID NO: 1452 - DNA, 8323 bp, Friend murine leukemia virus
gcgccagtcctccgatagactgagtcgcccgggtacccgtgtatccaataaatcctcttgctgttgcatccgactcgtggtctcgctgttccttgggagggtctcctcagagtgattgactacccgtctcgggggtctttcatttgggggctcgtccgggatctggagacccctgcccagggaccaccgacccaccaccgggaggtaagctggccagcaattgttctgtgtctgtccattgtcctgtgtctttgattgattttatgcgcctgtgtctgtactagttggccgactagattggtatctggcggatccgtggtggaactgacgagttcgagacacccggccgcaaccctgggagacgtcccagggacttcgggggccatttttgtggcccggccagagtccaaccatcccgatcgttttggactctttggtgcaccccccttagaggaggggtatgtggttctggtaggagacagagggctaaaacggtttccgcccccgtctgagtttttgctttcggtttggaaccgaagccgcgccgcgcgtcttgtctgctgcagcatcgttctgtgttgtctctgtttgactgtttttctgtatttgtctgaaaacatgggccaggctgttaccacccccttaagtttgactttagaccactggaaggatgtcgaacggacagcccacaacctgtcggtagaggttagaaaaaggcgctgggttacattctgctctgcagaatggccaaccttcaacgtcggatggccacgagacggcacttttaacccagacattattacacaggttaagatcaaggtcttctcacctggcccacatggacatccggatcaggtcccctacatcgtgacctgggaagctatagcagtagacccccctccctgggtcagacccttcgtgcaccctaaacctcccctctctcttcccccttcagccccctctctcccacctgaacccccactctcgaccccgccccagtcctccctctatccggctctcacttctcctttaaacaccaaacctaggcctcaagtccttcctgatagcggaggaccactcattgatctactcacggaggaccctccgccttaccgggacccagggccaccctctcctgacgggaacggcgatagcggagaagtggcccctacagaaggagcccctgacccttccccaatggtatcccgcctgcggggaagaaaagaaccccccgtggcggattctactacctctcaggcgttcccccttcgcctgggagggaatggacagtatcaatactggccattttcctcctctgacctctataactggaaaaataacaacccctctttctccgaggacccagctaaattgacagctttgatcgagtccgttctccttactcatcagcccacttgggatgactgccaacagctattagggaccctgctgacgggagaagaaaaacagcgagtgctcctagaggcccgaaaggcggttcgaggggaggacggacgcccaactcagctgcccaatgacattaatgatgcttttcccttggaacgtcccgactgggactacaacacccaacgaggtaggaaccacctagtccactatcgccagttgctcctagcgggtctccaaaacgcgggcagaagccccaccaatttggccaaggtaaaagggataacccagggacctaatgagtctccctcagcctttttagagagactcaaggaggcctatcgcagatacactccttatgaccctgaggacccagggcaagaaaccaatgtggccatgtcattcatctggcagtccgccccggatatcgggcgaaagttagagcggttagaagatttgaagagtaagaccttaggagacttagtgagggaagctgaaaagatctttaataaacgagaaaccccggaagaaagagaggaacgtattaggagagaaacagaggaaaaggaagaacgccgtagggcagaggatgtgcagagagagaaggagagggaccgcagaagacatagagaaatgagtaagttgctggctactgtcgttagcgggcagagacaggatagacagggaggagagcgaaggaggccccaactcgaccacgaccagtgtgcctactgcaaagaaaagggacattgggctagagattgccccaagaagccaagaggaccccggggaccacgaccccaggcctccctcctgaccttagacgattagggaggtcagggtcaggagcccccccctgaacccaggataaccctcagagtcggggggcaacccgtcaccttcctagtggatactggggcccaacactccgtgctgacccaaaatcctggacccctaagtgacaagtctgcctgggtccaaggggctactggagggaagcggtatcgctggaccacggatcgccgagtgcacctagccaccggtaaggtcacccattctttcctccatgtaccagattgcccctatcctctgctaggaagagatttgctgactaaactaaaagcccaaattcactttgagggatcaggagctcaggttgtgggaccaatgggacagcccctgcaagtgctgaccctaaacatagaagatgagtatcggctacatgagacctcaaaagggccagatgtgcctctagggtccacatggctctctgattttccccaggcctgggcagaaaccgggggcatggggctggccgttcgccaagctcctctgatcatacctctgaaggcaacctctacccccgtgtccataaaacaataccccatgtcacaagaagccagactggggatcaagccccacatacagagactgctggatcagggaattctggtaccctgccagtccccctggaacacgcccctgctacccgttaagaaaccggggactaatgattataggcctgtccaggatctgagagaagtcaacaagcgggtggaagacatccaccccaccgtgcccaacccttacaacctcttgagcgggctcccaccgtcccaccagtggtacactgtgcttgacttaaaagatgcttttttctgcctgagactccaccccaccagtcagtctctcttcgcctttgagtggagagatccagagatgggaatctcaggacaattaacctggaccagactcccgcagggtttcaaaaacagtcccaccctgtttgatgaagccctgcacagggacctcgcagacttccggatccagcacccagacctgattctgctccagtatgtagatgacttactgctggccgccacttctgagcttgactgtcaacaaggtacgcgggccctgttacaaaccctaggggacctcggatatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttgagtggggcccagaccagcaaaaggcctaccaagagatcaagcaggctctcttaactgcccctgccctgggattgccagacttgactaagcccttcgaactttttgttgacgagaagcagggctacgccaaaggtgtcctaacgcaaaaactggggccttggcgtcggccggtggcctacctgtccaaaaagctagacccagtggcagctgggtggcccccttgcctacggatggtagcagccatcgccgttctgaccaaagacgctggcaagctcaccatgggacagccactagtcattctggccccccatgcagtagaggcactagttaagcaaccccctgatcgctggctctccaacgcccgaatgacccactaccaggctctgcttctggacacggaccgagtccagttcggaccaatagtggccctaaacccagctacgctgctccctctacctgaggaggggctgcaacatgactgccttgacatcttggctgaagcccacggaactagaccagatcttacggaccagcctctcccagacgctgaccacacctggtacacagatgggagcagcttcctgcaagaggggcagcgcaaggccggagcagcagtaaccaccgagaccgaggtagtctgggccaaagcactgccagccgggacatcggcccaaagagctgagttgatagcgctcacccaagccttaaaaatggcagaaggtaagaagctgaatgtttacaccgatagccgttatgcttttgccactgcccatattcacggagaaatatatagaaggcgcgggttgctcacatcagaaggaaaagaaatcaaaaataaggacgagatcttggccctactgaaggctctcttcctgcccaaaagacttagcataattcattgcccgggacatcagaagggaaaccgcgcggaggcaaggggcaacaggatggccgaccaagcggcccgagaagtagccactagagaaactccagagacttccacacttctgatagaaaattcagccccctatactcatgaacattttcactatacggtgactgacataaaagatctgactaaactaggggccacttatgacgatgcaaagaagtgttgggtttatcagggaaagcctgtaatgcctgatcaattcacctttgaactattagattttcttcatcaattgacccacctcagtttctcaaaaacaaaggctcttctagaaaggaactactgtccttattacatgctgaaccgggatcgaacgctcaaagacatcactgagacttgccaagcctgtgcacaggtcaatgccagcaagtctgccgtcaaacaagggactagagttcgagggcaccgacccggcacccactgggaaattgatttcactgaggtaaaacctggcctgtatgggtataaatatcttttagttttcatagacactttctctggatgggtagaagctttcccaaccaagaaagaaactgccaaagttgtaaccaagaagctactagaagaaatcttccccagattcggcatgccacaggtattgggaaccgacaatgggcctgccttcgtctccaaggtaagtcagacagtagccgatttactgggggttgattggaaactacattgtgcttacagaccccagagttcaggtcaggtagaaagaatgaataggacaatcaaggagactttaactaaattgacgcttgcaactggctctagggactgggtgctcctgcttcccctagccctgtatcgagcccgcaacacgccgggcccccatggtctcaccccatatgaaatcttatatggggcacccccgccccttgtaaacttccctgatcctgacatggcaaaggttactcataacccctctctccaagcccatttacaggcactctacctggtccagcacgaagtctggagaccgttggcggcagcttaccaagaacaactggaccggccggtagtgcctcaccctttccgagtcggtgacacagtgtgggtccgcagacaccaaactaaaaatctagaaccccgctggaaaggaccttataccgtcctactgactacccccaccgctctcaaagtggacggcattgcagcgtggatccacgctgcccacgtaaaggctgccgacaccaggattgagccaccatcggaatcgacatggcgtgttcaacgctctcaaaatcccctaaagataagattgacccgcgggacctcctaatccccttaattctcttcctgtctctcaaaggggccagatccgcagcacccggctccagccctcaccaggtctacaacattacctgggaagtgaccaatggggatcgggagacagtatgggcaatatcaggcaaccaccctctgtggacttggtggccagtcctcaccccagatttgtgtatgttagctctcagtgggccgccccactgggggctagagtatcaggccccctattcctcgcccccggggcccccttgttgctcagggagcagcgggaacgttgcaggctgtgccagagactgcaacgagcccttgacctccctcacccctcggtgcaacactgcctggaacagacttaagctggaccaggtaactcataaatcaagtgagggattttatgtctgccccgggtcacatcgcccccgggaagccaagtcctgtgggggtccagactccttctactgtgcctcttggggctgcgagacaaccggtagagtatactggaagccctcctcttcttgggactacatcacagtagacaacaatctcacctctaaccaggctgttcaggtatgcaaagacaataagtggtgcaatcccttggctatccggtttacaaacgccgggaaacaggtcacctcatggacaactggacactattggggtctacgtctttatgtctctggacaggacccagggcttactttcgggatccgactcagttatcaaaatctaggacctcggatcccaataggaccaaaccccgtcctggcagaccaactttcgttcccgctacctaatcccctacccaaacctgccaagtctccccccgcctctagttcgactcccacattgatttccccgtcccccactcccactcagcccccgccagcaggaacgggagacagattactaaatctagtacagggagcttaccaggcactcaaccttaccaaccctgataaaactcaagagtgctggttatgcctagtgtctggacccccctattacgagggggttgccgtcctaggtacttattccaaccatacctctgccccagctaactgctccgtggcctcccaacacaagctgaccctgtccgaagtgactggacggggactctgcataggaacagtcccaaaaactcaccaggccctgtgcaacactacccttaaggcaggcaaagggtcttactatctagttgcccccacaggaactatgtgggcatgtaacactggactcactccatgcctatctgccaccgtgcttaatcgcaccactgactattgcgttctcgtggaattatggcccagggtcacctaccatcctcccagttacgtctatagccagtttgaaaaatcccatagacataaaagagaaccagtgtccttaaccttggccttattattaggtgggctaactatgggtggcatcgccgcgggagtagggacaggaactaccgccctggtcgccacccagcagtttcagcagctccatgctgccgtacaagatgatctcaaagaagtcgaaaagtcaattactaacctagaaaagtctcttacttcgttgtctgaggttgtactgcagaatcgacgaggcctagacctgttgttcctaaaagagggaggactgtgtgctgccctaaaagaagaatgttgtttctatgctgaccatacaggcctagtaagagatagtatggccaaattaagagagagactctctcagagacaaaaactatttgagtcgagccaaggatggttcgaaggatggtttaacagatccccctggtttaccacgttgatatccaccatcatggggcctctcattatactcctactaattctgctttttggaccctgcattcttaatcgattagttcaatttgttaaagacaggatctcagtagtccaggctttagtcctgactcaacaataccaccagctaaaaccactagaatacgagccacaataaataaaagattttatttagtttccagaaaaaggggggaatgaaagaccccaccaaattgcttagcctgatagccgcagtaacgccattttgcaaggcatggaaaaataccaaaccaagaatagagaagttcagatcaagggcgggtacacgaaaacagctaacgttgggccaaacaggatatctgcggtgagcagtttcggccccggcccggggccaagaacagatggtcaccgcggttcggccccggcccggggccaagaacagatggtccccagatatggcccaaccctcagcagtttcttaagacccatcagatgtttccaggctcccccaaggacctgaaatgaccctgtgccttatttgaattaaccaatcagcctgcttctcgcttctgttcgcgcgcttctgcttcccgagctctataaaagagctcacaacccctcactcggcgcgccagtcctccgatagactgagtcgcccgggtacccgtgtatccaataaatcctcttgctgttgca

SEQ ID NO: 1453 - DNA, 8332 bp, Moloney murine leukemia virus
tatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtccaaaaatcccgatcgttttggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgagaatatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccaaacctaaacctcaagttctttctgacagtggggggccgctcatcgacctacttacagaagaccccccgccttatagggacccaagaccacccccttccgacagggacggaaatggtggagaagcgacccctgcgggagaggcaccggacccctccccaatggcatctcgcctacgtgggagacgggagccccctgtggccgactccactacctcgcaggcattccccctccgcgcaggaggaaacggacagcttcaatactggccgttctcctcttctgacctttacaactggaaaaataataacccttctttttctgaagatccaggtaaactgacagctctgatcgagtctgttctcatcacccatcagcccacctgggacgactgtcagcagctgttggggactctgctgaccggagaagaaaaacaacgggtgctcttagaggctagaaaggcggtgcggggcgatgatgggcgccccactcaactgcccaatgaagtcgatgccgcttttcccctcgagcgcccagactgggattacaccacccaggcaggtaggaaccacctagtccactatcgccagttgctcctagcgggtctccaaaacgcgggcagaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagacattgggagaaagttagagaggttagaagatttaaaaaacaagacgcttggagatttggttagagaggcagaaaagatctttaataaacgagaaaccccggaagaaagagaggaacgtatcaggagagaaacagaggaaaaagaagaacgccgtaggacagaggatgagcagaaagagaaagaaagagatcgtaggagacatagagagatgagcaagctattggccactgtcgttagtggacagaaacaggatagacagggaggagaacgaaggaggtcccaactcgatcgcgaccagtgtgcctactgcaaagaaaaggggcactgggctaaagattgtcccaagaaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatcctggacccctaagtgataagtctgcctgggtccaaggggctactggaggaaagcggtatcgctggaccacggatcgcaaagtacatctagctaccggtaaggtcacccactctttcctccatgtaccagactgtccctatcctctgttaggaagagatttgctgactaaactaaaagcccaaatccactttgagggatcaggagctcaggttatgggaccaatggggcagcccctgcaagtgttgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggttgctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctacacctcagaacattttcattacacagtgactgatataaaggacctaaccaagttgggggccatttatgataaaacaaagaagtattgggtctaccaaggaaaacctgtgatgcctgaccagtttacttttgaattattagactttcttcatcagctgactcacctcagcttctcaaaaatgaaggctctcctagagagaagccacagtccctactacatgctgaaccgggatcgaacactcaaaaatatcactgagacctgcaaagcttgtgcacaagtcaacgccagcaagtctgccgttaaacagggaactagggtccgcgggcatcggcccggcactcattgggagatcgatttcaccgagataaagcccggattgtatggctataaatatcttctagtttttatagataccttttctggctggatagaagccttcccaaccaagaaagaaaccgccaaggtcgtaaccaagaagctactagaggagatcttccccaggttcggcatgcctcaggtattgggaactgacaatgggcctgccttcgtctccaaggtgagtcagacagtggccgatctgttggggattgattggaaattacattgtgcatacagaccccaaagctcaggccaggtagaaagaatgaatagaaccatcaaggagactttaactaaattaacgcttgcaactggctctagagactgggtgctcctactccccttagccctgtaccgagcccgcaacacgccgggcccccatggcctcaccccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccgaccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgacatggcgcgttcaacgctctcaaaaccccttaaaaataaggttaacccgcgaggccccctaatccccttaattcttctgatgctcagaggggtcagtactgcttcgcccggctccagtcctcatcaagtctataatatcacctgggaggtaaccaatggagatcgggagacggtatgggcaacttctggcaaccaccctctgtggacctggtggcctgaccttaccccagatttatgtatgttagcccaccatggaccatcttattgggggctagaatatcaatcccctttttcttctcccccggggcccccttgttgctcagggggcagcagcccaggctgttccagagactgcgaagaacctttaacctccctcacccctcggtgcaacactgcctggaacagactcaagctagaccagacaactcataaatcaaatgagggattttatgtttgccccgggccccaccgcccccgagaatccaagtcatgtgggggtccagactccttctactgtgcctattggggctgtgagacaaccggtagagcttactggaagccctcctcatcatgggatttcatcacagtaaacaacaatctcacctctgaccaggctgtccaggtatgcaaagataataagtggtgcaaccccttagttattcggtttacagacgccgggagacgggttacttcctggaccacaggacattactggggcttacgtttgtatgtctccggacaagatccagggcttacatttgggatccgactcagataccaaaatctaggaccccgcgtcccaatagggccaaaccccgttctggcagaccaacagccactctccaagcccaaacctgttaagtcgccttcagtcaccaaaccacccagtgggactcctctctcccctacccaacttccaccggcgggaacggaaaataggctgctaaacttagtagacggagcctaccaagccctcaacctcaccagtcctgacaaaacccaagagtgctggttgtgtctagtagcgggacccccctactacgaaggggttgccgtcctgggtacctactccaaccatacctctgctccagccaactgctccgtggcctcccaacacaagttgaccctgtccgaagtgaccggacagggactctgcataggagcagttcccaaaacacatcaggccctatgtaataccacccagacaagcagtcgagggtcctattatctagttgcccctacaggtaccatgtgggcttgtagtaccgggcttactccatgcatctccaccaccatactgaaccttaccactgattattgtgttcttgtcgaactctggccaagagtcacctatcattcccccagctatgtttacggcctgtttgagagatccaaccgacacaaaagagaaccggtgtcgttaaccctggccctattattgggtggactaaccatggggggaattgccgctggaataggaacagggactactgctctaatggccactcagcaattccagcagctccaagccgcagtacaggatgatctcagggaggttgaaaaatcaatctctaacctagaaaagtctctcacttccctgtctgaagttgtcctacagaatcgaaggggcctagacttgttatttctaaaagaaggagggctgtgtgctgctctaaaagaagaatgttgcttctatgcggaccacacaggactagtgagagacagcatggccaaattgagagagaggcttaatcagagacagaaactgtttgagtcaactcaaggatggtttgagggactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcagcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattt

SEQ ID NO: 1454 - DNA, 8135 bp, Murine type C retrovirus
gcgccagtcatccgatagactgagtcgcccgggtacccgtgttcccaataaagccttttgctgtttgcatccgaaacgtggcctcgctgttccttgggagggtctcctctgagtgattgactacccggctcgggggtctttcatttgggggctcgtccgggatttggagacccccgcccagggaccaccgacccaccgtcgggaggtaagctggccagcgatcgttttgtctccgtccctgtctttgtgcgtgtgtgtgtgtgccggcatctactttttgcgcctgcgtctgaatctgtactagttagctaactagatctgtatctggcggttccgtggaagaactgacgagttcgtattcccgaccgcagccctgggagacgtctcagaggcatcaggggcccgctgggtggcccgatcagtaagtccgagtcctgaccgattcggactatttggagcccctcctttgtcggagggggacgtggttcttttaggagacgagaggtccaagccctcgccgcctccatctgaatttttgctttcggtttttcgccgaaaccgcgccgcgcgtcttgtctgtctcagtgttgttttgtcatttgtctgttcgttattgttttggaccgtttctaaaaatatgggacagaccgtaaccacccctctgagtctgaccctagaacactggggagacgtccagcgcatcgcgtccaaccagtccgtggacgtcaagaagagacgctgggtcaccttctgctctgccgagtggccaactttcggtgtagggtggccgcaagatggtacttttaatttggacattattttacaggttaaatctaaggtgttctctcccggtccccacggacacccggatcaggtcccatacattgtcacctgggaggctattgcctatgaaccccctccgtgggtcaaaccttttgtctctcccaaactctccctctctccaaccgctcccatcctcccatccggtccttcgacccaacctccgccccgatctgccctttaccctgctcttaccccctctataaaacccagaccttctaaacctcaggttctctccgataatggcggacctctcattgaccttctcacagaagaccctccgccgtacggagaacagggaccgtcctcctctgacggagatggcgacagagaagaggccacctccactcctgagattcctgccccctctcccatggtgtctcgcttgcggggcaaaagagaccccccccgcggcagtttccaccacctctcgggctttccgcactccgtttggggggtaatggtcagttgcagtactggccggttttcctcctcggatctatataactggaaaaataataacccttccttctccgaagatccaggtaaattgactgccttaatcgagtctgtcctcaccacccaccagcctacttgggatgactgtcaacagttgctggggactctgctgacaggagaagaaaagcagcgggtgctcctggaagccagaaaggcagtccggggcgacgatggccgccccacccaattgcccaatgagatcgaggctgctttccccctcgaacgtcccgactgggactacaccacccttagaggtaggaaccacctagttctctatcgccagctgctcttggcgggtctccaaaatgcgggcaggagccccaccaatttggctaaggtaaaaggaataacccaggggtccaacgagtcgccctcggcctttctagagagactcaaagaggcctatcgcagatacactccttatgaccctgaggaccctgggcaagaaaccaatgtatccatgtcgttcatctggcagtctgctccagacattggtcgaaagttagagcggttagaagacttaaaaaataagaccttaggggacttagtgagagaagcagaaaggatctttaataagagagagaccccagaagagagagaagaacgtattaagagagaaacagaggaaaaagaggagcgccgtagggcagaggatgagcagaaagagaaagagagggaccgcagaagacagagagaaatgagcaaactcttggccaccgtagttacaggtcagagacaggatagacaggggggagagcgaaggaggccccaactcgataaggaccaatgcgcctactgcaaagaaaagggacactgggctagggattgcccaaagaagccacgggggccccgaggaccgaggccccagacctccctcctgaccctagatgactagggaggtcagggtcaggagcccccccctgaacccaggataacccttactgtcggggggcaaccagtcaccttcctggtggatactggggcccaacactccgtgctgacccagaaccctggacccctaagtgacaggtctgcctgggtccaaggggctactggaggaaagcggtatcactggaccacagatcgcaaggtgcacctggctaccggtaaggtcactcactctttcctccatgtgccggactgcccttatcctttgctaggaagggacttgttgactaagttaaaggcccagatccacttcgagggatcgggagctcaggttgtgggaccaaaaggacagcccctgcaggtgttgacccttggcatagaggatgagtatcggctacatgagacctcaacagagccggatgtttctctagggtccacctggctttctgactttccccaggcctgggcagaaaccgggggcatgggactggcagttcgccaagcgcctctgattatacctctaaaggcaacctccacccctgtgtccatcaaacagtaccccatgtcacacgaagccagactggggatcaagccccacatacagagactgttggaccagggaatattggtaccttgccagtccccctggaacacacccctgctgcccgttaagaaaccagggactaatgattacaggcctgtccaggatctgagagaagtcaacaagcgggtggaagatatccaccccaccgtgcccaatccttacaacctcttaagtggactccctccgtcccaccagtggtacactgtgcttgatttaaaagatgcctttttctgcctgagactccaccccaccagtcagcctctctttgcctttgagtggagagatccagaaatgggaatctctggacaattgacctggaccagactcccacagggtttcaaaaacagtcccaccctgtttgatgaggcattgcacagagacctagcagacttccggatccagcacccagacttgatcctgctacagtacgtggatgacttactgctggccgctacttccgaactagactgccaacaaggtactcgggcccttctacaaaccctaggggacctcggataccgggcctcggccaagaaagcccaaatctgccagaaacaggttaaatacctggggtaccttctgagggagggtcagagatggctgactgaggctagaaaagagactgtgatggggcaacccgttccaaagactcctcgacaactaagggagttcctagggacggcaggcttctgccgcctctggatccctgggtttgcggaaatggcggcccccttgtatcctcttaccaaaacggggactctgtttaattggggcccagaccagcaaaaggcctatcaagaaatcaaacaggcccttctaactgcccccgccctgggattgccagatttgactaagccctttgaactctttgtcgacgagaagcagggctacgccaaaggcgtcctaacgcaaaaactgggaccttggcgtcggcctgtggcctacctgtccaaaaagctagacccagtggcagccgggtggcccccttgcctacggatggtagcagccattgccgttctgacaaaagatgcaggcaagctaactatgggacagccgctagtcatcctggccccccatgcagtagaggcactggtcaagcaaccccctgaccgctggctatccaacgcccgcatgacccactaccaggcaatgctcctagacactgaccgagttcagttcggaccagtggtggccctcaatcctgccaccttgctccctctaccggaaaaaggagccccccatgattgcctcgagatcttggctgaaacgcatggaaccagaccggatctcaccgaccagcccatcccagacgccgaccacacctggtataccgatgggagcagctttctgcaagaaggacagcgaaaggctggggcagcagtgacgactgaaaccgaggtaatctgggcgagggccctgccagctggaacgtcagcccagcgagccgaactgatcgcactcacccaagccctgaaaatggcagaaggtaagaagctaaatgtttacactgatagccgctatgccttcgctacggcccatgttcatggggaaatatataggagacgggggttgctgacctcagaaggcaaggaaatcaagaacaaaagcgagatcctagccttgctgaaagccctctttttgccaaagagactcagtattatccattgcccaggacatcagaaaggagacagtgccgaagccagaggcaaccgtatggcagaccaggcggcccgagaggcagccacaaaaacagttccagaagcctctacactccttatagaggactcgaccccgtacacgcctgcctatctccattacaccgaaacagatctaaaaagattgcgagaactgggggccacctataatcagataaaaggatattgggtcctacaaggcaagccggtgatgcccgatcagtttgtgtttgaattattagactcccttcatagactcacccatctcagccctcaaaagatgaaggcgctccttgacagagaagaaagcccctactacatgttaaacagggacagaactcttcagtatgtggcagaatcctgcacagtctgtgctcaagtaaatgctagtaaagccaaaatcggggcaggggtacgagtacgcgggacatcgaccagtacccattgggaaattgacttcactgaagttaaaccagggctgtacgggtacaagtacctcctggtgttcgtagacaccttctctggctgggtggaagccttcccaactaaacgtgaaactgccaaggttgtgaccaagaagctattagaagaaatattcccaagattcgggatgccacaggtattgggttccgataatgggcctgccttcgtctcccaggtaagtcagtcggtggccgatttactggggatcgattggaaattacattgtgcttatagaccccagagttcaggtcaggtagaaagaatgaatagaaccatcaaggagactctaactaaattaaaccttgcagctggcactagagactgggtactcctactccccttagccctctaccgagcccggaacactccgggcccccatggactgactccgtatgaaattctgtatggggcacccccgccccttgtcaattttcatgatcctgaaatgtcaaagttaactaatagtccctctctccaagctcacttacaggccctccaagcagtacaacgagaggtctggaagccgctggccgctgcttatcaggaccagctagatcagccagtgataccacaccccttccgtgtcggtgacgccgtgtgggtacgccggcaccagactaagaacttggaacctcgctggaaaggaccctacaccgtcctgctgaccacccccaccgctctcaaagttgacggcatctctgcgtggatacacgccgctcacgtaaaggcggcgacaactcctccggccggagcagcatggaaggtccagcgttctcaaaaccccttaaagataagattaacccgtggggccccctaatagttatagggatcttggtgagggcaggagcctcggtacaacgtgacagccctcaccaggtcttcaatgtcacttggagagttaccaacctaatgacaggacaaaacagtaacgctacctccctcctggggacgatgacagacaccttccctaaactatattttgacttgtgtgatttagttggagaccattgggatgacccagaacccgatattggagatggttgccgctctccggggggaagaaaaaggacaagactgtatgacttctatgtttgccccggtcatactgtaccaatagggtgtggagggccgggagagggctactgtggcaaatggggatgtgagaccactggacaggcatactggaagccatcatcatcatgggacctaatttcccttaagcgaggaaacactcctaaggatcagggcccctgttatgattcctcggtctccagtggcgtccagggtgccacaccggggggtcgatgcaaccccctagtcttagaattcactgacgcgggtaaaaaggccagctgggatgcccccaaagtttggggactaagactctaccgatccacgggggccgacccggtgacccggttctctttgacccgccaggtcctcaatgtaggaccccgcgtccccattgggcctaatcccgtgatcactgaacagctacccccctcccaacccgtgcagatcatgctccccaggcctcctcatcctcctccttcaggcgcggcctctatggtgcctggggctcccccgccttctcaacaacctgggacgggggacaggctgctaaacctagtaaaaggagcctatcaagcactcaacctcaccagtcccgacagaacccaagggtgctggctgtgtctggtatcgggacccccctactacgaaggggttgccgtcctaggtacctactccaaccatacctctgccccagctaactgctccgtggcctcccaacacaagctgaccctgtccgaagtgaccgggcagggactctgcgtaggagcagttcccaaaacccatcaggccctgtgtaataccacccagaaggcgagcgacgggtcctactatctggctgctcccgccgggaccatctgggcttgcaacaccgggctcactccctgcctatctaccactgtactcaacctcaccaccgattactgtgtcctggttgagctctggccaaaggtgacctaccactcccctggttatgtttatgaccagtttgagagaaaaaccaaatataaaagagagccggtgtcattaactctggccctgctgttgggaggacttactatgggcggcatagctgcaggagtaggaacagggactacagccctagtggccaccaaacaattcgagcagctccaggcagccatacatacagaccttggggccttagaaaaatcagtcagtgccctagaaaagtctctgacctcgttgtctgaggtggtcctacagaaccggagaggattagatctgctgttcctaaaagaaggaggattatgtgctgccctaaaagaagaatgctgtttctatgcagaccacactggcgtagtaagggatagcatggctaagctaagagaaaggctaaaccagaggcaaaaattgttcgaatcaggacaagggtggtttgagggactgtttaacaggtccccatggttcacgaccctgatatccaccattatgggccctctgatagtacttttattaatcctactcctcggaccctgcattctcaaccgcttggtccagtttgtaaaagacagaatttcggtggtgcaggccctggttctgacccaacagtatcaccaactcaaatcaatagatccagaagaagtagaatcgcgtgaataaaagattttattcagtttccagaaagaggggggaatgaaagaccccaccataaggcttagcaagctagctgcagtaacgccattttgcaaggcatgaaaaagtaccagagctgagttctcaaaagtcacaaggaagtttagttaaagaataaggctgaacaaaactgggacaggggccaaacaggatatctgtggtcgagcacctgggccccggctcagggccaagaacagatggtactcagataaagcgaaactagcaacagtttctggaaagtcccacctcagtttcaagttccccaaaagaccgggaaaaaccccaagccttatttaaactaaccaatcagctcgcttctcgcttctgttaacgcgctttttgctccccagccctataaaagagggtaaaaccccacactcggt

SEQ ID NO: 1455 - DNA, 11954 bp, Eastern chimpanzee simian foamy virus
tgtggtggaatgccactagaaaccagggaaaacaaggaggagagtattacagggaaggaggtgaagaacctcattacccaaatactcctgctcctcatagacgtacctgggatgagagacacaaggttcttaaattgtcctcattcgctactccctctgacatccaacgctgggctactaaagcattgccttatggctggaaagtggtcaccgaaagcggaaatgattatactagccgcagaaagatcagaacattgacagagatgactcaggatgaaattagaaaaaggtgggaaagtggatattgtgaccccttcattgactcaggaagtgactcagatggacccttctaaaagccacagacagtaaaaatgtgttagcactttatacaatattatatctgcttaagctatagaagctttcacatactcagtagctgtttcacaatcaacaaaacaatgatgatgtaatcataaggaagtagtttaaaataggttaataagtttattagttatatagaaaataatataggataaagtataaggattaaggtatgaggtgtgtggctcaacacgtagggtgacaagaaaatctactgtaataggacacaacacctctaaagttgcccgtgggaaggtgaagtgagatcgaatctttccttaacgcagacagctttttatccactagggataatgttttaaggaatactatagtaatagattgatagttttaacaatgatggaaatagtatataaggatagtttctagattgtacgggagctctcttcactactcgctgcgtcgagagtgtacgagactctccaggtttggtaagaaatattttatattgttataatgttactatgatccattaacactctgcttatagattgtaagggtgattgcaatgctttctgcataaaactttggttttcttgttaatcaataaaccgacttgattcgagaacctactcatatattattgtctcttttatactttattaagtaaaaggatttgtatattagccttgctaagggagacatctagtgatataagtgtgaactacacttatcttaaatgatgtaactccttaggataatcaatatacaaaattccatgacaattggcgcccaacgtggggctcgaatataagtcgggtttatttgtaaattatccctagggacctccgagcatagcgggaggcatataaaagccaatagacaatggcttcaggaagtaatgttgaagaatatgaacttgatgttgaagctctggttgtaattttaagagatagaaatataccaagaaatcctttacatggagaagttataggtcttcgccttactgaaggatggtggggacaaattgagagatttcagatggtacgtctaatattacaaaatgatgataatgaacctttacagagacctagatatgaggtaatacaacgagctgtaaaccctcatacaatgtttatgatatcaggaccattagctgaacttcaattagcctttcaggatttagatttacctgaaggtccattgaggtttggtccattggcaaatggacattatgttcaaggagatccttatagtagttcttacagaccagtaacaatggccgaaacagcccaaatgactagagatgaactggaagatgttcttaatactcaaagtgaaatagaaattcaaatgataaatttattggagttgtatgaagttgaaactagagctcttagaagacaattagctgagagatctagtacagggcaaggaggaatatccccaggagctcctcgttctcgaccaccagtaagcagcttctcagggttaccaagtttgccctctatacctgggattcatcccagggcaccttcacctccaagggcaacttctactccgggaaatattccttggagtttaggagatgataacccaccttcatctagttttcctggaccctctcaacctcgtgtttctttccatccgggaaatccttttgttgaagaagaaggtcatagacctagatcccagtctagagaaaggagaagagaaattcttcctgctcctgtaccgtcagcacctcctatgattcagtatataccagtaccacctccaccaccgattggcacggttatacctattcagcatatcagatctgtaactggagagcctcctagaaacccaagagaaataccaatttggctaggacgaaatgctcctgctatagatggagtgttccctgttacaacaccggatctaagatgcagaataattaatgctatactaggaggaaatattgggctatcattaacccctggagactgtttaacatgggactcagcagtagccaccttatttattagaacccatggaacttttccaatgcatcagcttggaaatgtaataaaaggcatagttgatcaagaaggagtggcaacagcatatactttgggaatgatgctttctggacaaaattatcaattagtttctggaataattagaggatatttgcctggacaagctgtagtaactgcattacaacagcgtttagaccaagaaatagatgatcaaacaagagcagagacttttattcaacatctaaatgctgtatatgaaattttaggccttaatgccagaggacaaagtatacgtgcttcagtgactcctcaaccccgaccatccagaggtagaggtcgaggtcaaaatacttctagaccctctcaaggaccagctaatagcgggcggggacgacagcgccctgcttctggtcaaagcaacagaggatctagtactcagaatcaaaatcaagataatttaaatcaaggaggatataatcttcgaccccgtacttaccaacctcaaaggtacggaggaggacgtggacgaagatggaacgataatactaacaatcaagagtccagaccatcagatcaaggttctcaaactcctaggccaaatcaagcaggctctggggtgcgtggcaatcagtcacaaactcccagaccagctgctggtcgcggaggaagaggtaaccacaaccgaaaccaacgatcatccggtgctggtgactcacgcgctgtcaataccgtgacacagagtgccacgtcctccacagatgaatcctcttcagctgttacagccgcttccggcggagatcaaagggactaaattgttagcccactgggattcaggggcaacaataacttgtattcctgaaagttttttagaagatgaacaacctattaaaaagactttaataaaaacaattcatggagaaaaacaacaaaatgtttattatgtaacctttaaagttaaaggaagaaaagtggaagcagaagtgatagcttctccttatgagtatattttgctgtcgccaacagatgttccttggttaacacagcaaccacttcagttaacaattttagttcctcttcaagaatatcaagagaaaatcttaagtaagactgctcttccagaagatcaaaaacaacaattaaaaaccttgtttgtcaagtatgacaatctatggcaacattgggaaaatcaagtcgggcatagaaaaattaggccacataatatagcaactggtgattatcctcctcgccctcaaaaacaatatcctattaatcctaaggcaaagcctagtatacaaattgtaatagatgacttattgaaacaaggggtgttaacgcctcaaaatagtacaatgaatacaccagtgtatcctgttcctaaaccagatggaaggtggagaatggtattagattatagagaagtaaataaaactattccattaacagctgcccaaaaccaacactctgctggtattttagctactattgttagacaaaaatataaaactaccttagatttagctaatggattttgggctcatcctattacaccagaatcttattggttaacagcatttacctggcaaggtaaacagtattgttggacacgtcttcctcaaggatttttaaatagtccagcattgtttacagctgatgtagtagatttactaaaagaaatccctaatgtacaagtgtatgttgatgatatatatttaagccatgatgatcctaaagagcatgttcaacaattagaaaaagtgtttcaaattttactacaggcaggatatgtagtatctttgaaaaaatcagaaattggtcaaaaaactgtagaatttttaggatttaatattactaaagaaggtcgtggcctaacagacacttttaaaacaaaactgttaaatattactcctccaaaagacttaaagcaattacaaagcatattaggattgttaaattttgctagaaattttatacctaattttgctgaactggtacaaccattatacaatttaatagcctcagcaaaaggcaaatatattgagtggtctgaagaaaatactaaacaattaaatatggtaatagaagcattaaacactgcctctaatttagaagaaaggttaccagaacagagactggtaattaaagtcaatacttctccatcagcaggatatgtaagatattataatgagactggtaaaaagcctattatgtacctaaattatgtgttttccaaagcagaattaaaattttctatgttagaaaaactattaactacaatgcacaaagccttaattaaggctatggatttggccatgggacaagaaatattagtttatagtcccattgtatctatgactaaaatacaaaaaactccactaccagaaagaaaagctttacccattagatggataacatggatgacttatttagaagatccaagaatccaatttcattatgataaaaccttaccagaacttaagcatattccagatgtatatacatctagtcagtctcctgttaaacatccttctcaatatgaaggagtgttttatactgatggctcggccatcaaaagtcctgatcctacaaaaagcaataatgctggcatgggaatagtacatgccacatacaaacctgaatatcaagttttgaatcaatggtcaataccactaggtaatcatactgctcagatggctgaaatagctgcagttgaatttgcctgtaaaaaagctttaaaaatacctggtcctgtattagttataactgatagtttctatgtagcagaaagtgctaataaagaattaccatactggaaatctaatgggtttgttaataataagaaaaagcctcttaaacatatctccaaatggaagtctattgctgagtgtttatctatgaaaccagacattactattcaacatgaaaaagggcatcagcctacaaataccagtattcatactgaaggcaatgccctagcagataagcttgccacccaaggaagttatgtagttaattgtaataccaaaaaaccaaacctggatgcagagttggatcaattattacagggtcattatataaaaggatatcccaaacaatatacatattttttagaagatggcaaagtaaaagtttccagacctgaaggggttaaaattattccccctcagtcagacagacaaaaaattgtgcttcaagcccacaatttggctcacaccggacgtgaagccactcttttaaaaattgccaacctttattggtggccaaatatgagaaaggatgtggttaaacaactaggacgctgtcaacagtgtttaatcacaaatgcttccaacaaagcctctggtcctattctaagaccagataggcctcaaaaaccttttgataaattctttattgactatattggacctttgccaccttcacagggatacctatatgtattagtagttgttgatggaatgacaggattcacttggttataccccactaaggctccttctactagcgcaactgttaaatctctcaatgtactcactagtattgcaattccaaaggtgattcactctgatcaaggtgcagcattcacttcttcaacctttgctgaatgggcaaaggaaagaggtatacatttggaattcagtactccttatcacccccaaagtagtggtaaggtggaaaggaaaaatagtgatataaaacgacttttaactaaactgctagtaggaagacccacaaagtggtatgacctattgcctgttgtacaacttgctttaaacaacacctatagccctgtattaaaatatactccacatcaactcttatttggtatagattcaaatactccatttgcaaatcaagatacacttgacttgaccagagaagaagaactttctcttttacaggaaattcgtacttctttataccatccatccacccctccagcctcctctcgttcctggtctcctgttgttggccaattggtccaggagagggtggctaggcctgcttctttgagacctcgttggcataaaccgtctactgtacttaaggtgttgaatccaaggactgttgttattttggaccatcttggcaacaacagaactgtaagtatagataatttaaaacctacttctcatcagaatggcaccaccaatgacactgcaacaatggatcatttggaacaaaatgaataaagcgcatgaggcacttcagaatacaacaactgtgactgaacagcagaaggaacaaattatactggacattcaaaatgaagaagtacaaccaactaggagagataaatttagatatctgctttatacttgttgtgctactagctcaagagtattggcctggatatttttagtttgtatattgttaatcattgttttggtttcatgctttgtgactatatccagaatacaatggaataaggatattcaggtattaggacctgtaatagactggaatgttactcaaagagctgtttatcaacccttacagactagaaggattgcacgttcccttagaatgcagcatcctgttccaaaatatgtggaggtaaatatgactagtattccacaaggtgtatactatgaaccccatccggaacccatagtggtgaaggagagggtcctgggtctttctcaaattctgatgattaattcagaaaacattgctaataatgctaatttgacacaagaagtaaagaagttgttaactgaaatggttaatgaagaaatgcaaagtttgtcagatgtaatgattgactttgaaattcctttaggagaccctcgtgatcaagaacaatatatacatagaaaatgctatcaagaatttgcaaattgttatttagtaaaatataaagaacccaaaccgtggcctaaggagggccttatagctgatcaatgcccattaccaggttaccatgctggattaacctataatagacagtctatttgggattactatattaaagtggagagtattagacctgcaaattggacaacaaagagtaaatatggacaagctagactaggaagtttttatattcctagcagtctgagacaaatcaatgttagtcatgtactattctgtagtgatcaattatattctaaatggtataatatagaaaataccatagaacaaaacgagcggtttctgcttaataaactaaataaccttacatctggaacctcagtattgaagaaaagagctcttccgaaggattggagttctcaaggtaaaaatgctctgtttagagaaatcaatgtgttagatatctgcagtaaacctgaatctgtaatactattgaatacttcatactattccttctctttatgggaaggagattgtaattttactaaagatatgatttctcagttggttccagaatgtgatggattttataacaattctaagtggatgcatatgcatccatatgcttgtagattctggagaagtaagaatgaaaaagaagaaactaaatgtagagatggggaaactaagagatgtctgtattatcctttatgggacagtcccgaatctacatatgattttggttatttagcataccaaaagaattttccttcccctatctgtatagaacaacagaaaattagagatcaagattatgaagtttattctttgtatcaagaatgcaaaatagcttctaaagcatatggaattgatacagttttattctctctaaagaattttcttaattatacaggaactcctgtaaatgaaatgcctaatgcaagagcttttgtaggcctaatagatcccaagtttcctccttcctatcccaatgttactagggaacattatacttcctgtaataataggaaaagaagaagtgttgataataactatgctaagttaaggtctatggggtatgcacttacaggagcagtgcaaaccttatctcaaatatcagatattaatgatgaaaacttacagcaaggaatatatttattaagggatcatgtaataaccttaatggaagctacattgcatgatatatctgttatggaaggaatgtttgctgtacaacatttgcatacacatttgaatcatttgaagacaatgcttctagaaagaagaatagactggacctatatgtctagtacttggctacaacaacaattacagaaatctgatgatgagatgaaagtaataaagagaattgctagaagtttggtatattatgttaaacaaacccatagttctcccacagctacagcctgggagattggattatattatgaattggttatacctaaacatatttacttgaataattggaatgttgtcaatataggtcacttagttaaatcagctggacaattgactcatgtaactatagctcatccttatgaaataatcaataaggaatgtgtagagactatatatctgcatcttgaagactgcacaagacaagattatgtcatatgtgatgtggtaaagatagtgcagccttgtggcaatagctcagacacgagtgattgtcctgtctgggctgaagctgtaaaagaaccatttgtgcaagtcaatcctctgaaaaacggaagttatctggttttggcaagttccacagactgtcagatcccaccatatgttcctagcatcgtgactgttaatgaaacaacgtcatgctttggactggactttaaaaggccactggttgcggaagaaagattgagctttgagccacgactgccaaatctacaactaagattaccacatttggttggaattattgcaaaaatcaaagggataaaaatagaagtcacatcctctggagaaagtataaaagagcagattgaaagagcaaaagctgagctccttcgactggacattcacgagggagatactcctgcctggatacaacagctagctgcagcaacaaaggacgtctggccagcagcagcttctgctctacaaggaattggtaactttttatctgggactgcccaaggaatatttggaactgcctttagtctcttgggatacttaaagcctatcctaataggagtaggggtcattctcttggttattcttatatttaagattgtatcatggattcctacgaaaaagaagaatcagtagcctccacctctggaattcaggacctgcagactctgagtgagcttgttggccctgaaaatgccggagagggagagctgactattgctgaggaacctgaagaaaatcctcgacgccccagacgatataccaaaagagaagtcaaatgtgtgtcttatcatgcatataaagaaattgaggacaaacatcctcaacatattaaactgcaggattggatccccacaccagaggaaatgagtaagtcactctgtaaaagacttattttatgtggattgtatagtgcagaaaaggcctcagagattttaaggatgccttttacagtttcttgggaacaatcagatactgaccctgactgttttattgtaagctatacatgtatattttgtgatgctgtaatacatgatcccatgcccataagatgggatcctgaagttggaatttgggtaaaatataaacccctcagaggaattgttggatctgctgtgtttattatgcataaacatcaaagaaactgttctcttgttaaaccttctaccagttgctcagaaggtccaaaaccaagacctaggcacgatcctgtccttcgatgtgacatgtttgaaaagcatcacaagcctcggcagaaacgacccaggagacgatccatcgataatgagtcatgtgcttccagtagtgacaccatggccaatgagccaggatcactatgcaccaaccctctttggaatcctggaccgctactatcagggctacttgaagagtccagcaacctaccaaacttggaagttcacatgtcaggtggacccttctgggaagaggtttatggggactcaattttgggtcccccctctgggtcaggtgaacattcagttttataagaattatcagattctaacttgctgtcaggctgtagacccatttgctaatatttttcatggtactgatgaagaaatgtttgacattgattcaggtcctgatgtttggtgttctccctctttgtgtttcaaggtaatttatgaaggggcaatgggccaaaagcaagaacaaaaaacctggctgtgcagactaggacatggtcatcgtatgggagcatgcgattaccgtaaagtagatctgtatgcaatgagacaaggaaaagaaaacccttatggagataggggtgatgcagctttgcaatatgcttatcaggttaaaaggggctgtaaagcagggtgcttggcatcacctgtacttaactacaaagctttgcagtttcatagaaccattatggcagacttcaccaatcctaggattggaaaaggacatcttgctcatggataccaagcagctatggaagcttatggacctcaaagaggaagaaacgaggagagggtgtggtggaatgccactagaaaccagggaaaacaaggaggagagtattacagggaaggaggtgaagaacctcattacccaaatactcctgctcctcatagacgtacctgggatgagagacacaaggttcttaaattgtcctcattcgctactccctctgacatccaacgctgggctactaaagcattgccttatggctggaaagtggtcaccgaaagcggaaatgattatactagccgcagaaagatcagaacattgacagagatgactcaggatgaaattagaaaaaggtgggaaagtggatattgtgaccccttcattgactcaggaagtgactcagatggacccttctaaaagccacagacagtaaaaatgtgttagcactttatacaatattatatctgcttaagctatagaagctttcacatactcagtagctgtttcacaatcaacaaaacaatgatgatgtaatcataaggaagtagtttaaaataggttaagtaagtttattagttatatagaaaataatataggataaggtataaggattaaggtatgaggtgtgtggctcaacacgtagggtgacaagaaaatctactgtaataggacacaacacctctaaagttgcccgtgggaaggtgaagtgagatcgaatctttccttaacgcagacagctttttatccactagggataatgttttaaggaatactatagtaatagattgatagttttaacaatgatggaaatagtatataaggatagtttctagattgtacgggagctctcttcactactcgctgcgtcgagagtgtacgagactctccaggtttggtaagaaatattttatattgttataatgttactatgatccattaacactctgcttatagattgtaagggtgattgcaatgctttctgcataaaactttggttttcttgttaatcaataaaccgacttgattcgagaacctactcatatattattgtctcttttatactttattaagtaaaaggatttgtatattagccttgctaagggagacatctagtgatataagtgtgaactacacttatcttaaatgatgtaactccttaggataatcaatatacaaaattccatgaca

SEQ ID NO: 1456 - DNA, 12983 bp, Macaque simian foamy virus
tgtggcaggcagccactaaatgtattggtcctggtgagggagattattggtgtgagtatgatcaccgtgggtatttccctattatacctaacaagctatctcctacgtgggtgagacatgctgccccctatggtatacaaaggctcgcaacaccatatgatctccagatgtttgcaaatgagttattgccacctggttacagtattaatactcccagtggaacttgctatgtgagcaatcgcaggcttcactatggaaatgaaggaactcttcaggagtatcaagagaactgtgacagaattaaaagaggatatgaggatatttcctctagtgattcttcagatgaggattaggggaagtttacccagcaactgcttatgcttgcttatgattcatgcctttgtttaggataagaatgtatttaaccatagttaatccttaggaagcatttggtaaattctactaagcaaacctgttcatttactaccgtgcttccgatggagaacttagggacgaggctgtgagttcgatatcatcctcatctcgagtgtctcccttttgcttttatagtaattagaaattatgcaataggtataagtataaaataataataagataatcctaagggagggagtggaacgtcctgatagaaaacaggcatgacgctctcccatccctccttttcatatgttcaaatctaaggtaatattattgattccttgccagctgttagcatagaaattaaataaaacaggaaaccacaagtaggtgaaggctagctcactgaataaattgactagtctttgctcaagaacccagggagcaatgttgtatgttcaaatctcaataatgcatcctggtcgttctttatgaagttatgtcattgtaaacaaaatatgaaagttagaaatgactgtccaaaaagccacaaagggaaatagctaatgtgcaaagtattagtcttgtacttggccgttctcctttggtattcaagttcaaatcctgtaagcagtattacagctgatgtaatgttaagtaataacttgttttctatatgagtgtaatattagctcctgatgactcacgaggtgaatggctcacagtgaacgacgactgaacattccttacgctgcgttgccaccacctccaggaatgcagtaggtatggagtagtgaattccagaatctcttcatactaactacattcttttgtatccacagttaggaattagtaaaggtagtttggaattctgtattagcttttagaagaagtataaaagcactatgatagattgtacgggagctcttcactactcgctgtgccgagagtgttcgagactctccaggcttggtaagaaatattataactttgttattctgatcctttctgtgctctgctatttagattgtaatgggtaaaggcaatgcttaatcagatttaatacaataaaccgacttaattcgagaaccatacttattttattgtctctttcaatactttatgtaaagtgaaaggagttgtgtattagccttgcttagggaaccatctagtggaataagtgggtactacacttatcataaaaggtgttagttcctaaggataatcaatacacaatattccatgacaattggcgcccaacgtggggctcgaatataagtcgaggtattatttaaagtgtttaaaaatctattccctagggaccttcacgcaccgcggaaggtattaattgttgcctaaataaaatggcagctgttgaaggtgatttagatgtccaagcattaactgatttgtttaataatctagggatcaatagagatcctagacatagagaggtaattgccctccgaatgaccggaggatggtggggaccagctactagatataatctgataactgtactattacaagatgaccaaggacaacctcttcagcaacctagatggagagctgaaggtagagctgctaatccagcagtcatgctcactctagaagctccttggcaagacctccggatggcttttgataatgttgatttagctgacgatactttaagatttggacctttagctaatggaaattatatcccaggtgatgaatactctttggaattcataccccctgctatgcaagaaatagcacaaatgcaaagggatgaacttgagaatgtattggatattgttggacaaataacaatgcaaatgagcgacttaataggtatgcaagacgctcaaattagaggactggaaggtcaaattagaggactaagaggcaatctaccagttgcaggaactccacctccaccacctcctagtttagatttacaacctgctgctgcctcttcaccttatgttgcaccagcatcttcagctcctgctgctcctgtagcatctgctgatttaggatggtttgctggaggacctagtcctggatcagtagatccaagattggccagggtagcttataacccttttttgcctggtccaagtgatggttctggggtagccccggttcagcccagtgctcctcctgcggcttcacctttactaccactaccaccagctcaacccgtgcagccagttattcaatatgtgcatccacctccaatgaatccggcacaacagattatacccattcaacatatacgagcagtaactgggaatgctccaactaatccacgagaaataccaatgtggataggaagaaatgcttcggctatagaaggggtgtttcctatgacaactcccgatttaagatgtagagtaattaatgctctacttggaggaaatctcggacttaatttagagcctcaacattgtgttacctgggcttcagctatagcaacactttatgtgaggactcatggttcttaccctattcatcaattagctgaagtccttagaggagtagccaattctgaaggagtagctgctgcctatcagcttggcatgatgttaactaatagagactataatttaatttggggaataattagacccctgttgcctggacaagctgtagttactgctatgcaacatcgccttgatcaagaaatcaatgatgctgctagagtagcttcttttattaatcatctgaatggtgtatatgaactcctaggcttgaacgccaggggacaaagccttaggatacctgcttctgggggacaaactacggctggaacctctgcaggaaggggtactcggggccgtaggagtcagcaaggaacccctggaagacaatcttcaggacaatcacaacaacaaggaagaagaagttcccagggccagtctaggcaatctgatagtagtgatcagaatgtgcaaagacagtcacaaggaggaaatggtagaggaggatataatctaagaccacgtacataccagccgcaaaggtacggaggcggacgaggtcgcagatggaacgatcaacctgcaagatcagataatcaacagcgttcccagtctcagcaaccgcagtcagaggctcgtggcgagcagtcacgaacatctggcgcggggcgtggacaaggaggaagagggaaccaaaaccgaaaccagcgatcagctggtggaaacgcagatagaactgtgaatacagtgacaactgcatccgcctcgacctctgcctcaggtcaagatggatcctctccagctcctccagcctctggaagcggaaatcaagggaactaaattaaaagcccactgggacagtggagctacaatcacttgtattccagaagcctttcttgaagatgaacaaccaatacagactatgctaattaagactattcatggagaaaaacaacagaatgtttattatttgacatttaagatacaaggaagaaaagtggaagcagaagtacttgcttccccatatgactatattttattaaatccatcagatgtcccatggcttatgaagaagcctttacaattgactgtgttagttcctcttcaagactaccaagaaagacttttaaaacagactactttgcctaaagaacaaaaggaccaattagaaaaattatttttaaaatatgatgcactttggcagcattgggaaaatcaagtaggacataggagaataaaaccacataacattgcaactggtacattagcccctaggcctcaaaaacaatatccaataaatcctaaagcaaaacctagtatacaaattgtaatagatgatctgttaaaacaaggtgtcttaatacaacagaacagcactatgaatactccagtgtatccagttccaaaacctgatggcaaatggagaatggttttagattatagagaagtaaataaaactatccctttaattgctgcacaaaatcaacattcagcagggatactctcctcaatttacagaggaaagtataaaactactttagatcttacaaatggattctgggcacatccgataactcctgaatcttattggttaacagcttttacttggcaaggaaaacaatattgttggactagactaccacagggatttctcaatagtcctgctctatttacagcagatgttgttgatttgttaaaagaagtaccaaatgtgcaagcatatgtggatgatatttatatgagtcatgatgaccctcaagagcatcttgaacaacttgagaaagttttttccatattactcaatgctggttatgtggtttctcttaaaaaatctgaaattgctcagagagaagtagaattcttagggtttaatattacaaaagaaggccgaggccttacagagacttttaaacaaaagttattgaatgtaattccacctaaagatttgaaacagttacagagcatattaggattattgaattttgctagaaattttattcctaattactctgagttggtaaaacctttatatactattgtagctaatgcaaatggtaaatttatatcttggacggaagaaaacagtaaccaattgcaatatattatttcagtgttaaatcaggcagataatttggaagaaagaaacccagagaccaggttaattcttaaagtcaattcctctccttctgctggatatattcgatattataatgaaggatctaaaagacctattatgtatgttaattatgtgttttccaaagctgaagttaaatttactcaaactgaaaaaatgttaacaactatgcataaaggccttattaaagccatggatttagcaatgggacaagaaatcttagtatacagtccaattgtttctatgaccaaaattcagaaaaccccattgcctgaaagaaaggcattacctgttagatggattacttggatgacatatttagaggaccctagaattcaatttcattatgataaaactctgcctgagttgcagcaaactccttctgttacagaagatgttattgcaaaaactaaacatccaagtgagtttgcaatggtattctatactgatgggtcagcaattaaacatcctgatattaataaatctcatagtgctggtatgggtattgctcaagttcaatttcaacctgaatataaagttatccaccaatggtctatacctttaggagatcatactgctcaattagctgaaattgcagcagtggaatttgcttgtaaaaaagccttaaaaatctctggtcctgtccttatagtcactgacagcttttatgtcgctgaaagtgctaataaggaattgtcatattggaaatctaatggttttcttaataacaagaaaaagcctcttaaacatgtttcaaaatggaagtccatagctgaatgtttacagctcaaacctgacattactataatacatgagaaaggacatcaacaacctatgactaccttacatacagaaggaaataatttagctgataagcttgccacccaagggagttatgtggttcattgtaataccaccccaagcctggatgcagagctggatcagttactacaaggacataatcctccagggtatccaaaacaatataaatacacccttgaggataataaaattatagttgaaaggcctaacggacaacggatagtgcctccaaaatctgatagagaaaagattatctctatggcccacaacattgctcatacaggacgagacgctactttcttgaaagtctcttccaagtattggtggcctaacctaagaaaggatgtggttaaagtcatcagacaatgtaaacagtgtctggtaacaaatgctgcaaatttaacttcgcctccaatacttaggcctgaaaagcctcttaagccttttgacaaattttatattgattatattggaccattaccaccttccaatggctatctacatgtccttgtagtagtcgatggtatgacaggctttgtatggttataccccacaaaggctccctcgactagcgcaactgttaaagctctcaatatgctcactagtattgcaattccaaaggtgctgcattctgatcaaggagcagcattcacctcttcaacttttgctgattgggctaaagaaaaaggtatacaattggaattcagtactccttaccatccccaaagtagtggcaaggtggaaaggaaaaatagtgacattaaacgacttttaactaaactgctaattgggagacctgctaagtggtatgatctattgcctgttgtacaattggcattaaataattcttatagtccatcttctaaatatactcctcatcaactcttgtttggtgtagattccaacacaccgtttgccaattctgacacacttgacttatccagagaagaagagttatctcttttgcaggaaatcagatcttctttgcaccaaccaacctcccctcctgcctcctctcgttcctggtcaccttcggttggccaattggtccaggagagggtagcccgccctgcttcacttcgacctcgttggcacaaaccaactagcatattggaagtagtaaacccacggacagtggttattttggaccatcttggcaaccgacgaactgtaagtgtggataatcttaaattaacagctcaccaaaataatggcaccaccaatgactctggaacaatggctcctgtggaagaagatgaatcaggctcaccaagctcttgaaaatgtaactgtattgactgaagaacagaaacagcaggttattgtggacattcagcaagaagaagttattcctactaggatggacaaattgaagtacctagcatattcatgttgtgccactagtacacgtgtattatgctggatagtattaatttgtatactattattagttgtgtttatctcttgttttgtgaccatgtccagaatacaatggaataaggatattgctgttttaggcccagtcatagactggaatgttagtcaacaagctgtgattcaacaaatcagagctaaaagattagcaaggtcacttagggtggaacatgctacagaggcgtatgtggaaattaatatgaccagcataccccaaggagtgttatatatccctcatccagaacccataattctcaaggagagggttcttggtctttcacaggttataatgataaattctgaaaatattgctaatactgctaaccttacacaagaaactaaggtattattggcagacatgattaatgaagaaatgaatgatttagccaatcaaatgatagattttgaaattcctttaggagatccgagagaccaaaagcaatatcagcatcaaaaatgctatcaagaatttgctcattgttatttgattaaatataagaccgctaagggatggtccagttctacggtgattgcagatcaatgtcctttgccaggaaatcatcccacagtacaatatgcccatcaaagcatatgggattattatattccatttgaacaaattaaaccagaagggtggacttctaaaacatattatgaagatgccagagttggaggattttatatcccaaagaggcttaggaataattcatatactcatgtgttactttgttcagatcaaatttatggaaaatggtataatatagatcttactacccaggagagggaaagattattggtacaaaagttaattaatttaactaaaggaaatacttcacaactaaaagatagggccatgcccacagaatggaataagcaaggaaaagctaatttattcaggcaaattaatcctttagacgtttgtaatagaccagaaatggtattcttattaaattcttcctattatgagttctccttatgggaaggtgattgtggatttactagacaaaatgctactcaagctaatccattatgtaaagatttttacaataattccaaatggaaaaacctgcatccgtatgcctgtaggttttggaggtataaacaagaaaaagaagaaacaaaatgtagtaatggggaaaagaaaagatgtctttattatccccaatgggatagtccagaggccctatatgattttgggtttctagcttatctaaatgcttttccatctcccatatgtattaaaaatcaaactattagagatccagaatacgaggtatactctttatatatggaatgtatgaatgcctctgatagatatgggattgacagtgcattattagctcttaaaacatttctaaatttcactggtcagtctgtgaatgagatgccattagccagggcctttgtaggcctcactgatcctaaatttcctcctacatatccaaatgttacaagggaaacttctggttgtaataataatagaagacaacgcagaagtattaataactatgaaaagattagatctatgggatatgcattaacaggagctgttcaaactttatcccaaatatctgatattaatgatgagaggctgcaacaaggagtatatttactccgggatcatgtggtaaccctgatggaagccgctcttcatgatgtttcaattatggaaggaatgttggcaattcagcatgtacatactcatcttaatcatctcaagactatgcttttaatgagaaaaatagattggaccttcatcagaagtgattggattcaacaacaattgcaaaaatctgaagatgaaatgaaactcataagaagaactgcaaaaagtttagtttattatgttacccaaacttctagttctcctactgctacttcttgggagataggaatatattatgaaataaccattcctaaacatatatatttgaataattggcaagtgatcaatgtaggtcatttagtagaatcagctggacatctgactcatgtcaaagttaagcatccttatgagataattaatagagaatgcagcaacactcaatatttacatcttgaagaatgcatcagagaggattatgtgatttgtgatatagtacaaatagtacaaccatgtgggaatgaaacagagttaagtgactgtccagtcactgctctcaagataaagtctccatatattcaagtctctcccttaaagaatggaagctacttaattttgtccagtacaaaagattgctctataccagcatatgtacctagtgtggttacagtcaatgaaacagttaagtgctttggagtagagtttcataaaccactctacgctgaaacaaaaaccagctatgaaccacaggttccacatttgaagcttcgtttaccccacttgactgggattattgccagcctgcaatcactggaaatagagattacttcaactcaagagaatataaaagaccaaattgaaagagccaaagcacagctacttcggctggacatccacgaaggagactttcctgactggcttaagcaagttgcctctgcaaccaaggacgtgtggcctgcagctgcttcattcctacaaggagtaggtaattttctatctaacactgcccaagggatatttggatcagcggtaagcctcctatcctatgccaagcctatcttggtgggaataggagttatcctgcttattgcccttctctttaagatcatatcatggcttcctgggaagatcaagaagaactaagggaacttctgcatcatctcccagaagatgatcccccggcagatctttctcacttactgaatcttgatgaaatggaacctaaggttcttggaggacaaaatcctggagatgagaaactacgacaacaagtaatcaagcctcccagtatacatccatctacagtaacttggcattttggatataaagataaagaagatcaacaaccagaaataaaaatgagagactgggtaccagacccttcaaaaatgagtaagtcaacatgtatgagattaatattgttaggattataccaagcttgtaaagcacaggagattataaaaatggactttgatgtacattgggaacaatctagagttaataagcaatattttgaagtagaatatagttgtagaatgtgtagaacagttctacatgaacctatgcccataatgtatgatccagaaactgaactttgggtaaagccaggacgccttagaggacccctaggatctgctgtttacacacttaaaaaacattatgaacgatgcttatctgcccttcctagcttcgaaggaactcggctcccaaagcgtcgcgctaatcctagcagaagatatgaagcattcagaaagcatactccaactaggaaacggcgctccaaggaagggatttccactgaccagcagccctctacttccagtggtgaccccatggcccttatctcaggaccatgtggcccccactctatacagcctcctggttgcatattacaagagcttccaaaaccagaagttggaacctccgaaatggctgtggcaatgtctggaggacccttctgggaggaagtgtatggtgactcaatttttggtgccccctttgggacaagtgatgatcagttgctatcgcaatttgactagtataataatatgtcaagcagtagatccttgggaaaataataatgaaacagattggaaaagggatcctatggctagacctaggatcagatgtgatcatgccctttgttttaaagtagtttatgaaggaaccccttggcgtactcatgatcagaagagttggcttattcgcctaactgagggacataaacatgggatggaagaattgtccccaggtgactggaaaatactccaggaatcccgtccttatccttatggaccagttggagaagatcctaacttgcaatatgctgtcagtgttaaaatgaaggtaactgggggccctttaacctcaacagtgttagccttaaaagctttatgctttcatagagttaacatttgtaatatggataatcctggtctaggagagggacatccccctcttggatattctcatgcactgaaggcatatggacctcagtatggtagttgcgaggagagggtgtggcaggcagccactaaatgtattggtcctggtgagggagattattggtgtgagtatgatcaccgtgggtatttccctattatacctaacaagctatctcctacgtgggtgagacatgctgccccctatggtatacaaaggctcgcaacaccatatgatctccagatgtttgcaaatgagttattgccacctggttacagtattaatactcccagtggaacttgctatgtgagcaatcgcaggcttcactatggaaatgaaggaactcttcaggagtatcaagagaactgtgacagaattaaaagaggatatgaggatatttcctctagtgattcttcagatgaggattaggggaagtttacccagcaactgcttatgcttgcttatgattcatgcctttgtttaggataagaatgtatttaaccatagttaatccttaggaagcatttggtaaattctactaagcaaacctgttcatttactaccgtgcttccgatggagaacttagggacgaggctgtgagttcgatatcatcctcatctcgagtgtctcccttttgcttttatagtaattagaaattatgcaataggtataagtataaaataataataagataatcctaagggagggagtggaacgtcctgatagaaaacaggcatgacgctctcccatccctccttttcatatgttcaaatctaaggtaatattattgattccttgccagctgttagcatagaaattaaataaaacaggaaaccacaagtaggtgaaggctagctcactgaataaattgactagtctttgctcaagaacccagggagcaatgttgtatgttcaaatctcaataatgcatcctggtcgttctttatgaagttatgtcattgtaaacaaaatatgaaagttagaaatgactgtccaaaaagccacaaagggaaatagctaatgtgcaaagtattagtcttgtacttggccgttctcctttggtattcaagttcaaatcctgtaagcagtattacagctgatgtaatgttaagtaataacttgttttctatatgagtgtaatattagctcctgatgactcacgaggtgaatggctcacagtgaacgacgactgaacattccttacgctgcgttgccaccacctccaggaatgcagtaggtatggagtagtgaattccagaatctcttcatactaactacattcttttgtatccacagttaggaattagtaaaggtagtttggaattctgtattagcttttagaagaagtataaaagcactatgatagattgtacgggagctcttcactactcgctgtgccgagagtgttcgagactctccaggcttggtaagaaatattataactttgttattctgatcctttctgtgctctgctatttagattgtaatgggtaaaggcaatgcttaatcagatttaatacaataaaccgacttaattcgagaaccatacttattttattgtctctttcaatactttatgtaaagtgaaaggagttgtgtattagccttgcttagggaaccatctagtggaataagtgggtactacacttatcataaaaggtgttagttcctaaggataatcaatacacaatattccatgaca

SEQ ID NO: 1457 - DNA, 11700 bp, Feline foamy virus
tgtcatgggccaaagagaattctcacagaggagaatactctctgctgccatctagtgacgatgaggaagaagaaatgtcagaaagagaggaattattgtgccatataaatcagtgtcaacaaaagctcttttatcccggagggacgactgatgtccttggaatggaaagcaatgtttggctcactaaatttgttaatattaaatttcctaaaggaacaaaagtgatacttcctgatggaagaaaattcatagcctgtgatcctgagctaaaaccattattgcaggaattgaaattcttggatagggcaacatctgagtcatctgactctgaatagaaagcctgaatttacctggattatgcaactttgtccgaggtggcagagtggttatgtatctgtcatactcggggaaagttttgtctttacatgttcaagacatataaagggtggaaaaatatattcctgactaaacttcctggggactagaggtgtggaaactttgctgcctctgcttcacgggaagtttttggttcgaatccttttttaggtacttagttaagataagtagtgaataaattactctcgttcatgtattcatatcgaaactatgtatcctttaaaaccatgtattctttagtcatctagatacttagagtatgaaaaaagaaactgcaatagtaactatcaatgttagtaaataaagtacagcttagtcatctgatgatgtcacgagaaaagaacctagaagagaagaacaactttcggcatgcaacagagcgggagcttggtgtaggagctaagtcaccgtcttacatctagagcctactcttcttgaactgttcgaatcctatttttggaactcttacatcacctttaagagactgaaaagcatgactcgtgcacaggaagctcctttagggtagaggaaatgttctaatctcctatcttaaagggttgcttcatttaaggttcgaaactgtgtactggaagtagattttgcataactttaaacttttagttgcatgtttctgctattagcagcatataaaagggttatggtagattgtacgggagctcttctcacagacttggctgcgtccagggtgagattgagactctccagcttgggtaagattttgatatgtattttgcttgaatattatttgccttgctcaaaattaaataaattggcttttctttcactcaattgaagcttcatataattatattattgtctgaagccagaactcacatgagtggtgtttctctattcttggggaaaagtgttcttctatttgaaagtgttagagctactaagtgaagaactaatctatcccaggtataggccacgacagttggcgcccaacgtggggctcgattgagtgaaatttaaattaagctgaggagaataatccctagggaccttaccttactgaggaaggatggctcgagaattaaatcctctccaattacagcaactgtatataaataatggcttacaacctaatccaggacatggagatattattgctgtcagatttacaggaggaccttggggtccaggtgatagatgggctagagtgacaatacgattacaagataacacaggacaacctttacaggttcctggatatgatttggaacctgggataataaatttgagagaggatatcttgatagcagggccatataatttaataagaactgcctttttggacttagagcctgccagaggacctgaaaggcatggtccctttggagatggcagattacagcctggagatggtttatctgaaggatttcaacctatcactgatgaagaaatacaagcagaagtaggaactattggtgctgctagaaatgagataagattattacgagaagctttacagagattacaagctggaggtgtgggtagacctataccaggagcagttttacaaccacaaccagtaatagggccggtaataccaattaatcatcttaggtcggttattggcaatactccaccaaatccacgagatgtcgccctatggcttggaagatctacagccgctattgaaggagtatttcccatagtggaccaagtcactcgtatgagggtagttaatgccttagtagcatctcatcccggcctaacgttgactgagaatgaggccgggagctggaatgctgccatatcagctttatggaggaaagctcacggtgctgcagctcagcatgaattggcaggagtattaagtgatattaataaaaaggaaggcatacaaactgcattcaacctaggaatgcaatttacagatggaaactggtccttagtatggggaataatcaggactcttttaccaggacaagccctagtaaccaatgctcagtcacaatttgacctaatgggagatgatatacaacgagcagaaaatttccccagggtcattaacaatctatacactatgctgggtctcaatatacatgggcaaagtattagacctcgggtccaaacacagccactacaaactcgaccccggaacccgggacgatctcaacaaggtcaactaaatcagccgagaccccaaaatagagctaaccaatcttatagaccccctagacaacaacagcaacactctgatgttcccgaacagagagatcagagaggaccgtcgcaacctcctcgtggaagtggaggaggatataattttagaagaaatccgcagcagcctcagcgctacggccaaggaccaccaggaccaaacccgtaccgacgattcggagacggcggtaatcctcaacagcagggaccaccaccaaaccgagggcctgatcaaggacctcggccaggaggcaatcccagaggaggaggaagaggtcaaggtccaagaaatggaggaggaagcgctgccgcagtacatacagtaaaagcgtctgaaaacgaaactaaaaatggatctgctgaagccgttgacggtggaaagaaagggggtaaagattaaaggttactgggactcccaagccgatattacctgtgttccaaaggacttgcttcaaggagaagaacctgttaggcagcaaaatgtgactactatacatggaacgcaggaaggagatgtatattatgtaaatttaaaaatagacggtagaagaattaatacagaagtaatagggacaactttggactatgctattataactcctggagatgtaccttggattttgaagaaacctctagaattgactattaaactagatttagaagagcagcaagggactttacttaacaattccattttatctaaaaaagggaaagaagaattaaaacaattatttgagaaatatagtgccttatggcaaagttgggagaatcaggtgggtcatagaagaattaggccacataaaatagcaactggtacagtaaaacccacacctcagaaacagtatcatattaatccaaaggcaaaacctgatattcagattgtgataaatgatttactaaaacaaggggtactaattcaaaaggaaagtactatgaacactcctgtctacccagtacccaagccaaatggtcgctggagaatggtactggactacagagcagtaaataaagtcacacctttgatagctgtacaaaatcaacactcgtatggaattttaggaagtctttttaaaggtagatataaaactacaattgatttatccaatggtttctgggcacaccccatagtcccagaggattattggattactgcattcacttggcaaggaaaacaatattgttggactgttttaccacaaggttttttaaacagccctgggttgtttactggagatgttgtagatcttctacagggaattcccaacgtggaagtctatgtggacgatgtatatattagtcatgattctgaaaaagaacatttggaatatctggatattttgtttaatagattaaaagaagcaggatatataatatctcttaaaaaatccaatattgccaattctattgtggattttcttggttttcagattactaatgaaggccggggcctgacagatacttttaaagaaaaattggaaaatattactgcccctaccactcttaaacaattgcaaagcatactaggtcttttaaattttgccagaaattttattcctgactttactgaattaattgctcctttatatgcattgataccaaagtctaccaagaattatgttccttggcaaatagaacattcaaccactctggaaactttaattactaaactaaacggggcagaatatttacaaggaagaaaaggagataaaacattgatcatgaaagtcaatgctagttatacaacaggatatataaggtattataatgaaggggaaaagaagccaatatcctatgtaagtatagtgttcagcaaaactgaattgaaattcactgaactagagaaattgctgaccactgtgcacaagggtcttttaaaggccttggacttgtcaatggggcaaaacattcatgtttattcccccattgtatccatgcaaaatattcaaaaaacaccacagactgctaaaaaggctttggcctctcgatggttgagttggctttcttatttggaagatccgagaattaggttcttttatgatccacagatgcctgctctaaaagatttgcctgctgtagacaccggaaaagataataaaaaacatcctagcaattttcaacatatattttacactgatggttctgctatcacgtcccctactaaggagggacatttaaacgctggaatgggaatagtttattttataaacaaagatggaaatttacaaaagcaacaggaatggtccattagtttggggaatcatacagcacaatttgcagaaatagctgcttttgagtttgcccttaaaaaatgtttgcctttgggaggaaacattcttgtggttactgacagcaattatgttgcaaaagcatataatgaggaacttgatgtttgggcctctaatggctttgtgaataacaggaagaaacctttgaaacatattagtaaatggaaatcggttgctgaccttaaaagattaaggccagatgttgttgtgacccatgagccaggtcaccaaaaacttgactcatctcctcatgcttacgggaataatctggctgatcaactggccacgcaagccagttttaaagtacatatgactaaaaatcccaagctggacattgagcaaataaaggcaattcaagcatgtcaaaataatgaaagattacctgttggttatccaaaacaatatacctatgagttgcaaaataataaatgtatggttttaagaaaagacggttggagggaaattcctccttcccgagaacggtataaacttattaaagaagcacataacattagtcatgcaggccgagaagccgtgttattaaaaatacaagaaaattattggtggccaaaaatgaagaaagatatatcatcttttctttctacatgtaatgtatgtaagatggtaaatcctttgaatttgaaacctattagccctcaagctattgtacacccaaccaaaccttttgataaattttatatggattacattgggccattgccaccatcagaaggttatgtgcatgttttagttgtggtagatgctgccactggatttacttggttgtaccccactaaggctcaaacctccaaggccacaattaaagttcttaatcatctcactggactagcaattccaaaggtgctgcattctgatcaaggatcagcatttacttctgaagaatttgctcagtgggcaaaggaaaggaatatacaattggaattcagtactccttaccaccctcaaagtagtgggaaagtggaaaggaaaaacagtgaaattaagaaacttttaactaagctcttggttgggaggcctttaaagtggtataaccttatatccagtgtgcaacttgctctaaataacactcatgttgtcagcaccaagtatactcctcatcaactaatgtttggaattgattgtaatttaccatttgctaataaggataccttggactggacaagagaagaagaacttgctctcttgcaggaaattcgtgaatctttacaacaccctgtacaaccccccacctgctctggttggtcaccatacgttggccagctggtccaggagagggtgtacaggccgtcacaattaaggcctaagtggaggaagcctacaaaggtcttggaaatattgaatcctagaactgtgattatagtggaccatctaggccaacggaaatctgtgagtattgacaatttaaaacctacagcacaccagcataatggaacaagaacatgtgatgaccctgaaggaatggatggaatggaatgctcacaaacaactacagaaacttcagtcgactcatcctgagttgcatgttgacatacctgaggatattcctttagtaccagagaaggtacctttgaaaatgaggatgcgatatagatgttatactttgtgtgctacttctactagaataatgttttggatactattctttcttctatgtttttcaatagttaccttgagtacaattataagtattcttagatatcaatggaaagaagcaataacacatcctggcccagtcttaagctggcaggtgactaattcacatgtaaccatgggaggaaatacttcctcttcctccagacggagacgtgatatacaataccacaaacttcccgtagaggttaacatctcagggatcccacaaggtcttttcttcgcacctcaaccaaaacctatatttcacaaagaaagaactttaggtctttctcaagtgattcttattgactctgatactattactcaaggtcatattaaacaacagaaagcatatttagtctcaacaattaatgaagagatggagcaattacaaaagacagtattaccttttgacttacccatcaaggaccctctaactcaaaaggaatacatagaaaaaaggtgctttcaaaaatatggacattgttatgttatagcttttaatggaaataaagtttggccttcacaagatttaatacaagatcaatgtccattacctcctcgctttggaaataacttaaagtataggaaccacactatatggaagtattatataccattgccatttaaagtatcctccaattggacaagagtagaatcctatggtaatattaggataggcagctttaaagttcctgatgaatttagacaaaatgccacacatggaatattttgttctgatgcactatatagtaattggtatccacgtgatctaccttcttcggtacaacaatcctttgctcaagcatatataacaaaggtacttatgaaaaggaaaaagcaacctactttacgagatatagcttttccaaaggaattgagccctgtaggctctggtatgctattcagacctattaacccatatgatatctgtaatatgccaagagcagtattattattaaataaaacatattatactttctcactatgggaaggagattgtggatattaccaacacaatcttactcttcatcccgcatgtaagaacttcaatagaactagacaagaccatccatatgcttgcagattttggagaaacaagtatgactctgagtcagtgcaatgctataataatgatatgtgttattatagacctttgtatgatggaactgagaatactgaggattggggatggctggcatatactgactcttttccatcccccatctgtattgaagaaaagcgaatctggaagaaaaattatactctgtcatctgtattagcagaatgtgtaaatcaagccatggaatatggtatagatgaagtattatccaaactagatctgatatttgggaatctgactcatcaatcagcagatgaggccttcattccggttaataatttcacttggcctagatatgagaaacaaaataaacaacaaaaaacctcttgtgaaagaaagaaaggtagaagacaaagaaggtccgtaagtacggaaaacctaagaaggatacaagaggcaggcttaggcctggccaatgcaattactactgtggctaagatctctgacctgaatgatcaaaaattagccaagggagtacatttgcttagagatcatgttgtcactctaatggaagccaatttggatgatattgtgtccctaggagagggaatacaaatagaacatatacataatcacttaacctctttgaaattgcttactttggaaaatagaattgactggaggtttataaacgattcatggattcaagaagaattaggtgtttcagataatataatgaaagtaataaggaaaactgcaaggtgcattccttacaatgtcaaacaaactaggaatctaaatacttccactgcatgggaaatatatttatattatgagatcatcattcctaccactatatatacacagaattggaatataaagaatctaggtcaccttgtaaggaatgcaggatatttatctaaggtgtggattcaacaaccatttgaagtactaaaccaggaatgtggaacaaatatatatttacatatggaagaatgtgttgaccaagactatataatatgtgaagaagtaatggaacttcctccttgtggaaatggaactggttcagactgcccagtgctaaccaaaccacttacagatgaatacttggaaattgaacccctaaagaatgggagttatttggttttatcaagtactacagactgtggcataccagcttacgtgcctgtggttataacggtgaatgacacaatcagctgttttgataaagagtttaaaaggccacttaaacaggaactaaaagtaacaaaatatgcaccatccgttcctcaattagaactaagagttcctcggttaacaagcctgattgcaaaaataaaaggaattcaaatagaaattaccagcagctgggaaactataaaagagcaagtcgcaagggccaaggcagagcttctacgcttggaccttcacgaaggagactatccagagtggctgcagctccttggagaagcaactaaagacgtttggcctacaatctccaacttcgtttctggaataggtaatttcataaaggacactgctggaggtatttttggaactgcctttagttttctgggatatgtaaaacctgtacttttgggatttgtgataatattttgcataattttaattataaaaatcataggatggcttcaaaatacccggaagaaggaccaataactgagggggttgaagaagattttaactcccattccacttctggtttggaccttacctcaggtaataaagaagaacctttgatttctttagccctattgtctatgcataccagtaaaattgttgtttggataagggatcacttttttgtaaaaatattatcctttggagggaagcaaaagttgtattatatatgcaaccaatgtcataaaggaattcctgaaagtggatacataactctcaatactaaatattatctatatgagaaaggacctactgagactggcaccaaaggtctaactcttatgagaaggcatgtgcaaaattccccttgtttcctgaacagtcggaaagaatccggaacacccaagacggatcctactcgtcctgcaacatcttatagcctatgccgaagcgactatcaagaagcaggatgttcccggcccactccttccaattctgagtccgtatgtaatggcttgggacaaccctcagaacgtggtcacacgtctggtgaatctgggggaatcatggaagaagtatcttttatctcctggttggaaggattgtggggagagggatttgactatgctaactagagaattgttggtaccaggaataggcctggtacaaatcgccgctacacttactaaaacctatgtgttaatgtgtaatgggcgatgtattacaggttctagaaccgacccagattgtgatcctttgttctgtaagttgttatgctggaaacaaaatatacaagaccctagagagtgtaacctagaagaatggtgcctgtatagtcttgatcctgaacatgatcccctttgggatccaaaaatgattgtgcgtagacataggaatcttttaccttattgtatgagaccctttctcatttggatgaattatatttctcacaatcctcttacacagcaatgtattatgatgaaaactttgaatatgctttggagagcacaagctgatgatccaagtgatgttgcttccctgtatcccagagtcaaagtttttaaggcatctcattttgacatatttggaagtgcctctgggaacagtgaggagagggtgtcatgggccaaagagaattctcacagaggagaatactctctgctgccatctagtgacgatgaggaagaagaaatgtcagaaagagaggaattattgtgccatataaatcagtgtcaacaaaagctcttttatcccggagggacgactgatgtccttggaatggaaagcaatgtttggctcactaaatttgttaatattaaatttcctaaaggaacaaaagtgatacttcctgatggaagaaaattcatagcctgtgatcctgagctaaaaccattattgcaggaattgaaattcttggatagggcaacatctgagtcatctgactctgaatagaaagcctgaatttacctggattatgcaactttgtccgaggtggcagagtggttatgtatctgtcatactcggggaaagttttgtctttacatgttcaagacatataaagggtggaaaaatatattcctgactaaacttcctggggactagaggtgtggaaactttgctgcctctgcttcacgggaagtttttggttcgaatccttttttaggtacttagttaagataagtagtgaataaattactctcgttcatgtattcatatcgaaactatgtatcctttaaaaccatgtattctttagtcatctagatacttagagtatgaaaaaagaaactgcaatagtaactatcaatgttagtaaataaagtacagcttagtcatctgatgatgtcacgagaaaagaacctagaagagaagaacaactttcggcatgcaacagagcgggagcttggtgtaggagctaagtcaccgtcttacatctagagcctactcttcttgaactgttcgaatcctatttttggaactcttacatcacctttaagagactgaaaagcatgactcgtgcacaggaagctcctttagggtagaggaaatgttctaatctcctatcttaaagggttgcttcatttaaggttcgaaactgtgtactggaagtagattttgcataactttaaacttttagttgcatgtttctgctattagcagcatataaaagggttatggtagattgtacgggagctcttctcacagacttggctgcgtccagggtgagattgagactctccagcttgggtaagattttgatatgtattttgcttgaatattatttgccttgctcaaaattaaataaattggcttttctttcactcaattgaagcttcatataattatattattgtctgaagccagaactcacatgagtggtgtttctctattcttggggaaaagtgttcttctatttgaaagtgttagagctactaagtgaagaactaatctatcccaggtataggccacgacagt

SEQ ID NO: 1458 - DNA, 7184 bp, Human papillomavirus 116
atggagaatccctttcctaacgatttgcgatcgtattgtaattattttggtatttgcttgtttgatttaaggttgcaatgtatattttgtaaatctatacttgatattgtagatttagccaaatttcataagaaagaattgcgtttggtttggagatgtaaagttgcttatgcatgctgttcaaaatgtttgtatgctagtgctagatatgaaaatgagaatcattttcaatgtgctgtaaaggcgtctactttgcatgatcttttgggaacaccattgcatcaaatttacatgaggtgtaaccattgtttaagtgggttagatttgcaagagaaatttgatttggtagctagagattgttatgttattttagtgagagggtattggagaggcccttgtagagattgtattaacagagaatattaaaatgaaaggtgatagagtaacaattaaggatgttgagttgcatttagaggaattggtgataccagcaaatttattaagtgatgaaagtttgtcattagatgaaacaccggaggaggagcaattgtcaccttacagggtggatagtttatgcactaggtgtaacaagtgtatcaggatttctgtagtttgcacaactggagccatttacacattggagcaacttctactttcgaccgagctgtcctttttgtgcgctgggtgttccaggaccaccgtgcgaaatggcagacgcttctaaaggtattgactcggtagatgacagttcatggtttattgtaaatgaagcagattgtatggatgacatagagactttagatacattgtttgatgaaagtgattgtgattctacagtctcgaatctaatagacgatgagaattttcaagaacagggaaactccctggcgttgttcaacatacagtgtgcagaggagtgtgataaaactgtttcactactaaaacgaaagtatgctcaaagtccgcagggatcatctgtggctgagcttagcccgagactggaagctgttaaaatttcacctgaaaaagaaagacaaagtaaaaggagattgtttcaggacagtggattaggcgaagatgaagctgaacttatttctgaacaggtagaagtgcaaacaaatgaaaatggcggcgacacattaagtgccgcatgtaatagtattttaaacagcaaatgtaagcggtcgctattgtttgtaaaatgtgagactttatttggtgtatcttacaatgaacttactagacaatttaaaagtcacaaatcatgttgtgaaaattggattgtatttgtgtatgcagcgggaacagaagttcttgaaagttcaaaagtattgttacagcagcattgtgaaaattttcaggtgatattatgtgatttttctggattatatgtgttgcaatttaagcatggaaaaaatagagaaaccgttgaaagactattttgcaacatattgcatgttacagatagtcatcttttatcagatcctcctagaagtaggagcgtacctgcagcattatttttttttaaaagaagtgtatctaaaacatcttatgtgtacaataatttgccagcgtgggtgacaaagctgacacaatttaatcatcaggtggcaacacagccagaagcatttgagttgtcaaaaatgattcaatgggcgtatgacaatagaatgactgaagaagcagaaattgcttatggttatgctttattagcagatgaagatacaaatgctgctgcatttttaaaaagcaatgttcaattaaaatatgttagagactgctgtactatggtaaaattgtacttcagacaagaaatgagagaaatgagtatttcacagtggatatggaagtgttgtaatgattgtgaaggcgaggcagactggaaacttatacttaattttctaaaattccaaaatattaatgtaatacaattcctcacatgtttaagaacattgtgtaaaagaattcctaaaaaaaattgtattttattctatggaccaccagatacaggaaaatcattttttgcctactcacttgttaaattcttacaaggtaaaatattgtcatttgtaaataaaacaagtaacttctggttacagccattattagattgtaaatttgcactgttagatgatgtgacttatccatgttggcaatacattgatcaaaacatgagaggagccttagatggcaatacaatgtgtgtagatgcaaaacatagagtgccacaacaaattaaactaccacctttgatattaaccagtaatattgatgttgtaaaggaagaatccttacaatatttacatagtaggttaatgtgctttgaatttgcaaataagttaccgtttgatactcatggcattcctgtttataattttactaatcaggtgtggaagtgtttcttccaaaaactgtcaagacaattagacctggaagaagaaaacatccaacatgaatcaatcagatctgacagaacgtttagatgcattgcaaacagccctgatgaacatttatgaagaagcaccaactgatttaccttcgcaaattagacactttgatttattaaggaaacaaagtgtacttgaatattatgttagaaaagaaggttatacacagttgggcctatatcatattccaacattaaaggtatctgaataccatgccaaggaagctattaagatgggaattgtgcttagatcattacaaaaatcaccctatgcagatgaagagtggtctttgcaagatgtaaatgctgacttttttaattcgcctcctagaaattgttttaaaaaaggagggtatgatgtagaagtttggtttgatcataatcctttaaatacatttccatatacaaactggacatggatatactaccaggatgatgaggaaaattggcataaagttcaaggagaaacagattataatgggttgttttatagagaaacggatggaactgtagtatactttttattatttgaaagtgatgctgccagatatggaactaaaaatgagtggactgtgaatgttaaaaatgaacaaatctcccttcctgccaacagcaacggtcggaggtcttcgtctgggaccccaactcactctaccaccaactctgtcgctgagccggggccctccagatccaccgaggaggccgacggacgaagaacgccacaagcacagacgcagagcgttggggcttccaaaaaaccatcttcggtcggacgacgaaggcgacgaaaacaaggaaaacaaacccccagcaaacgaagacgaactggaggaggaagcggagacgaagcagacagcggtggaatctctgctgaggaagttggaagtagccatcgatcagttgcacgatcaggtctatcgagacttgaacgacttcaaaaggaggctcgggatccgtatataatacttgtcagagggcctcagaatacattaaagtgttggaggtatagaatccaaacaaaagccaattttccctttctttatataagtacagtatggaaatgggtgactaaggatgctgttggacatgagggtcgggtacttattgcatttttaagtaaagagtccagggatttatttgcaaattctgtgcattttcctaaaaatactacacattcatatggttctctagatgctttgtaataatgatgcgaatacgtaggaaacgggcatctcctacagatttacataggagttgtgctttaggtggggattgctttcctgatgttgaaaataaactttcaggcaatactcttgcagatattttattaaaggcatttggaagtattctttatttgggtaacttgggcattggaactggtaagggtggtggaggtcaatatggatacacaccttttggaggcacaaggcctagcatatccagggctccagtaaggcctgcaattcctgtagatacagtagttccaggtgaagtattaccagtaacacctttggatcctgctattgtgccattaacagatggattaccagaacctgctgtaatagatgttcctggagctggtcctggtttgcctacagaaaccatagatgtgacaactgagttagatcttgtttctgaagtaactggtgttggtgaacatccttccgttacatatgatacaaacaatgtagctcagatagatgttcaagtacaacctcctcctcccaagcggattcttttagatacttcaattactgacacagaattagctgtgcagactcatgcatcacatgttgatgaacattacaatgtatttgttgatgcacaatttcatggggaacatataggagcttttgaacctgaaagtatagaattacaagaaattaatttaagacaagaatttgaaattgatgagggccctttaagaagtactcccttatcatcccgcgcaatcagtcgagctagagatttgtataatagatatgtgcaacaagttccaacaacacaactcgcttccgtctctaccccgagggttacatttgaattcgaaaatcccgcctttgaagctgaaatagctgacgtgttcaacagggaggttcaggagttagcaacacaggggcaggatgaggcagggacagacctaattcgcttaagtgacatcagatatggcgaatcaccagcgggtacagtcagggttagtaggttaggtcaaagggagggaatgattatgaggagtggcttacaagtaggccaacgtgtacatttttactatgacatatctcctatacctaaggaagctatagaactaagaacatttggagagtatagccatgaatatactgtagtagatgacctagccagttcatcttttataaatccctttgaacaaccggtagatggctctcttgaattttctgatgcagcattaatagattcagtagaagaagatttttcaggcacacatttaattttgacatcagcaaatgcagctgattccatagacatacctgtaatccccccgggtattggtgttagggtgtttgtagatgattatgccaaaggactatcagtattacatcctactataatagataacggggctatataccccacagacataagcagcaatattttacctcttactccatcatttagtattgatgttaattactccgattataatatacatcctgctaatataaggcgcaaacgcaaacactcctcctctctttacttttagatggctacttggacccctaacactggacggctttatcttcctcctgctaaacctgtggcgactgttctatcgactgatgattatattgtaccgacgaatctttattttcatgccaattcggacagactgttgactgttggccatccttactttgacgttttgaatgacgctactaaagcaatagaggttccaaaggtgtctggaaatcagtttagagttttaagattgaagttacctgatcctaataaatttgctttgatagataagtctgtttataatccagaaaaggaaaggctagtatggcgactacgaggtgtacagattgacagaggtggtcctctaggcataggaacgactggtcatccgttatttgacagattggcagatacggaaaatcctaatgtttatgcccctgcagaggtagatgacagtagacaaaatatgtcatttgaccccaaacaaaatcagctttttatagtgggttgtttaccagcaacaggtcagcattgggatattgctgaaccttgcaaagatccagcgccaccacctaactcctgtccacctataaagttgatgcatagtattattcaagacggggacatgagtgatataggtttgggtaatgtaaacttcaataatttttcagcttctagatctgatgctcctttagatgttataaactctgtttgtaaatggccagactttgttcaaatgaccaaagatacttatggagacagagtttggttttttggtaaaagagaacaagtttacactagacatatgcttgtcaaaggtggtgtagacggagacagcttaccccatgaacctacaagagcttattatattactccaaatactggtacattaccagatggtaatttaggtaaaatcagttactttccaactcctagtggttccctggtctccagtgaagccacaattttcaacaggccttattggttacatcaggctcaaggaaaaaataatggtattgcatggggtaataatatttttataaccttattagacaatacccacaatactaactttatattatcagtgtatactggtgcacgacctatggaggagggttatacttacaagaaggctgattttaaaaagtttttgcgtcacactgaagagttagagcttgaaatagttatgcagctctgtaaggtacctttagaggctaatgtgttggcccacatcaatgctatggatcctactatacttgaaaattggcagttagcatttgttccagcgccacctcagaacttggaggacacttacagatatattcaatctctagcaacaatgtgtcctgcggatgtccctccagcaaacaaaccagatccttttgagaaatattcattttgggatgttgatttaactgataaatttacctcagagttggatcaaacacctttgggacgcaagttcttgtatactatgggtatgctaaatggtaggaagcgtcccagggtagattacactacaggtaatactactgtgaagcgcgtgggcaaaactgctaagagaagaaaaactcgtatgtaattcttgtattgtattcatgttattaattatggtgtttaactgcattctgagcctgcacatatgtgtaataataaattacatgtgagtcatatgtttgtgggtatttatttactgtgtgtgcgctcgtacagctagtactgacccctctagaagcaaccactgttactcttcgcagccgaccgttttcggtaagtctaaaattaccactttcggttgccaaagtttaccgccttcggttgtttactgtcaagacgaccgttatcggttggtgagtcagtaatcccttcagctgcatgtttctggctgttagcctttgtaccgggagtggtcacatacctagctttattcaatagttgttaacaacaattaccactataggttttttcaaccgtgtgcggttgctataaaacccttcagtgtcagcagattcttgcattgctg
